(12) United States Patent
Otte et al.

(10) Patent No.: US 7,192,741 B2
(45) Date of Patent: Mar. 20, 2007

(54) DNA SEQUENCES COMPRISING GENE TRANSCRIPTION REGULATORY QUALITIES AND METHODS FOR DETECTING AND USING SUCH DNA SEQUENCES

(75) Inventors: Arie Peter Otte, Purmerend (NL); Arthur Leo Kruckeberg, Amsterdam (NL)

(73) Assignee: Chromagenics B.V., Amsterdam (NL)

( * ) Notice: Subject to any disclaimer, the term of this patent is extended or adjusted under 35 U.S.C. 154(b) by 505 days.

(21) Appl. No.: 10/190,312

(22) Filed: Jul. 5, 2002

(65) Prior Publication Data

US 2003/0199468 A1    Oct. 23, 2003

Related U.S. Application Data

(60) Provisional application No. 60/303,199, filed on Jul. 5, 2001.

(51) Int. Cl.
| | |
|---|---|
| C12N 5/10 | (2006.01) |
| C12N 5/18 | (2006.01) |
| C12N 15/00 | (2006.01) |
| C12P 21/00 | (2006.01) |
| C07H 21/04 | (2006.01) |

(52) U.S. Cl. .................. 435/70.3; 435/320.1; 435/358; 435/455; 435/325; 536/24.1

(58) Field of Classification Search ...................... None
See application file for complete search history.

(56) References Cited

U.S. PATENT DOCUMENTS

| | | | |
|---|---|---|---|
| 5,610,053 | A | 3/1997 | Chung et al. |
| 5,773,695 | A | 6/1998 | Thompson et al. |
| 5,888,809 | A | 3/1999 | Allison |
| 6,063,598 | A * | 5/2000 | Enenkel et al. ............ 435/69.1 |
| 6,395,549 | B1 | 5/2002 | Tuan et al. |
| 6,521,419 | B1 | 2/2003 | Koduri et al. |
| 6,586,205 | B1 | 7/2003 | Glucksmann et al. |
| 6,872,524 | B1 | 3/2005 | Otte |
| 2003/0138908 | A1 | 7/2003 | Koduri et al. |
| 2003/0166042 | A1 | 9/2003 | Glucksmann et al. |
| 2003/0199468 | A1 | 10/2003 | Otte et al. |
| 2005/0106609 | A1 | 5/2005 | Otte |

FOREIGN PATENT DOCUMENTS

| | | |
|---|---|---|
| EP | 1 273 666 | 1/2003 |
| WO | WO 96/04390 | 2/1996 |
| WO | WO 97/27207 | 7/1997 |
| WO | WO 98/11207 | 3/1998 |
| WO | WO 98/49289 | 11/1998 |
| WO | WO 00/05393 | 2/2000 |
| WO | WO 00/09749 | 2/2000 |
| WO | WO 00/17337 | 3/2000 |
| WO | WO 00/23606 | 4/2000 |
| WO | WO 01/59117 | 8/2001 |
| WO | WO 01/59118 | 8/2001 |
| WO | WO 02/24930 A2 | 3/2002 |
| WO | WO 03/004704 | 1/2003 |
| WO | WO 2004/055215 A1 | 7/2004 |
| WO | WO 2004/056986 A2 | 7/2004 |

OTHER PUBLICATIONS

GenBank Accession No. AL096766.12, GI: 5738627, Aug. 17, 1999.*
Frengen et al. Modular bacterial artificial chromosome vectors for transfer of large inserts into mammalian cells. Genomics. vol. 68, No. 2, pp. 118-126, Sep. 2000.*
GenBank Accession No. AC007689.13, GI: 8573011, Jun. 25, 2000.*
Shizuya et al. Cloning and stable maintenance of 300-kilobase-pair fragments of human DNA in *Escherichia coli* using an F-factor-based vector. Proc Natl Acad Sci U S A. vol. 89, No. 18, pp. 8794-8797, Sep. 1992.*
Van Der Vlag et al., Transcription Repression Mediated by Polycomb Group Proteins and Other Chromatin-associated Repressors Is Selectively Blocked by Insulators, Journal of Biological Chemistry, Jan. 7, 2000, pp. 697-704, vol. 275, No. 1.
Aranda et al., Definition of Transcriptional Pause Elements in Fission Yeast, Molecular and Cellular Biology, Feb. 1999, pp. 1251-1261, vol. 19, No. 2.
Auten et al., "Effect of Scaffold Attachment Region on Transgene Expression in Retrovirus Vector-Transduced Primary T cells and Macrophages," Human Gene Therapy, May 20, 1999, pp. 1389-1399, vol. 10, No. 8.
Bell et al., Insulators and Boundaries: Versatile Regulatory Elements in the Eukaryotic Genome, Science, pp. 447-450, vol. 291, No. 5503.
Burgess-Beusse et al., The insulation of genes from external enhancers and silencing chromatin, PNAS, Dec. 10, 2002, pp. 16433-16437, vol. 99, Suppl. 4.
Chan et al., p300-CBP proteins: HATs for transcriptional bridges and scaffolds, Journal of Cell Science, 2001, pp. 2363-2373, vol. 114.
Chung et al., A 5' Element of the Chicken Beta-Globin Domain Serves as an Insulator in Human Erythroid Cells and Protects against Position Effect in Drosophila, Aug. 13, 1993, Cell, pp. 505-514, vol. 74.
Database EBML 'Online!, Jul. 8, 1992, *H. sapiens* HOX4B gene upstream sequence XP002348163 retrieved from EBI, Database accession No. X67079, Abstract.

(Continued)

*Primary Examiner*—Celine Qian
*Assistant Examiner*—Jennifer Dunston
(74) *Attorney, Agent, or Firm*—TraskBritt

(57) ABSTRACT

The invention is concerned with the systematic elucidation and identification of regulatory sequences. The invention provides among others screenings and detection methods with which regulatory sequences can be identified. The invention further provides regulatory sequences and use thereof in various fields such as, but not limited to protein production, diagnostics, transgenic plants and animals, and the therapeutic field.

25 Claims, 65 Drawing Sheets

OTHER PUBLICATIONS

Eggermont et al., Poly(A) signals and transcriptional pause sites combine to prevent interference between RNA polymerase II promoters, The EMBO Journal, 1993, pp. 2539-2548, vol. 12, No. 6.
Emery et al., "A chromatin insulator protects retrovirus vectors from chromosomal position effects," Proceedings of the National Academy of Sciences of USA, Aug. 1, 2000, pp. 9150-9155, vol. 97, No. 16.
Farrell et al., Conserved CTCF Insulator Elements Flank the Mouse and Human Beta-Globin Loci, Molecular and Cellular Biology, Jun. 2002, pp. 3820-3821, vol. 22, No. 11.
Glucksmann et al., Database accession No. AAH76193, Oct. 29, 2001.
Han et al., "Matrix attachment regions (MARs) enhance transformation frequency and transgene expression in poplar," Transgenic Research, 1997, pp. 415-420, vol. 6.
Johnson et al., Requirements for utilization of CREB binding protein by hypersensitive site two of the Beta-globin locus control region, Nucleic Acids Research 2002, pp. 1522-1530, vol. 30, No. 7.
Kellum et al., A Group of scs Elements Function as Domain Boundaries in an Enhancer-Blocking Assay, Molecular and Cellular Biology, May 1992, pp. 2424-2431, vol. 12, No. 5.
Kwaks et al., Identification of anti-repressor elements that confer high and stable protein production in mammalian cells, Nature Biotechnology, May 20, 2003, pp. 553-558, vol. 21, No. 5.
Maniatis et al., Recognition Sequences of Repressor and Polymerase in the Operators of Bacteriophage Lambda, Cell, Jun. 1975, pp. 109-113, vol. 5.
Martinez-Balbas et al., The acetyltransferase activity of CBP stimulates transcription, The EMBO Journal, 1998, pp. 2886-2893, vol. 17, No. 10.
Mielke et al., "Stabilized, long-term expression of heterodimeric proteins from tricistronic mRNA," Gene, Aug. 22, 2000, pp. 1-8, vol. 254, No. 1-2.
Migliaccio et al., "Stable and unstable transgene integration sites in the human genome: extinction of the Green Fluorescent Protein transgene in K562 cells," Gene, Oct. 3, 2000, pp. 197-214, vol. 256, No. 1-2.
Partial European Search Report, EP 05 07 6209, dated Oct. 7, 2005.
Pile et al., "GAGA Factor-dependent Transcription and Establishment of DNase Hypersensitivity Are Independent and Unrealated Events In Vivo," J. of Biological Chemistry, Jan. 14, 2000, pp. 1398-1404, vol. 275, No. 2.
Reik et al., Biotechnologies and therapeutics: Chromatin as a target, Current Opinion in Genetics & Development, 2002, pp. 233-242, vol. 12.
Seum et al., A GAL4-HP1 fusion protein targeted near heterochromatin promotes gene silencing, Chromosoma, 2000, pp. 453-459, vol. 109.
Sigrist et al., "Chromatin Insulator Elements Black the Silencing of a Target Gene by the Drosophila Polycomb Response Element (PRE) but Allow trans Interactions Between PREs on Different Chromosomes," Genetics, Sep. 1997, pp. 209-211, Vol. 147, No. 1.
West et al., "Insulators: many functions, many mechanisms," Genes and Development, Feb. 1, 2002, pp. 271-288, vol. 16, No. 3.
European Search Report dated Dec. 22, 2005, for EP 05 07 6209.
Database EMBL 'Online! Aug. 4, 1999, "*Homo sapiens* chromosome 19 clone CTD-2540B15, complete sequence," XP002359985 retrieved from EBI accession No. EM_PRO:AC008738, database accession No. AC008738 for SEQ ID No. 7.
Database EMBL 'Online! Feb. 3, 2004, "Sequence 33099 from Patent WO02068579," XP002359986 retrieved from EBI accession No. EM_PRO:CQ747165, database accession No. CQ747165 for SEQ ID No. 9.
Database EMBL 'Online! Sep. 24, 2000, "*Homo sapiens* chromosome 4 clone RP11-680118, working draft sequence, 25 unordered pieces," XP002359987 retrieved from EBI accession No. EM_PRO:AC080087, database accession No. AC080087 for SEQ ID No. 9.
Database EMBL 'Online! Dec. 15, 1999, "*Homo sapiens* BAC clone RP11-572N21 from 2, complete sequence," XP002359988 retrieved from EBI accesssion No. EM_PRO:AC018470, database accession No. AC018470, for SEQ ID No. 17.
Database EMBL 'Online! Dec. 23, 1999, "Human DNA sequence from clone RP11-54H19 on chromosome 1 Contains the 3' end of the LMNA gene for lamin A/C, the gene for a novel protein similar to semaphorins (FLJ12287), a novel gene (KIAA0446), the PMFI gene for polyamine-modulated factor 1, the BGLAP gene for bone gamma-carboxyglutamate (gla) p," XP002359989, retrieved from EBI accession No. EM_PRO:AL135927, database accession No. AL135927 for SEQ ID No. 27.
Database EMBL 'Online! Apr. 26, 2001, "RST28606 Athersys RAGE Library *Homo sapiens* cDNA, mRNA sequence," XP002359990 retrieved from EBI accession No. EM_:BG209092, database accession No. BG209092 for SEQ ID No. 40.
Database EMBL 'Online! Sep. 29, 1999, "*Homo sapiens* genomic DNA, chromosome 22q11.2, Cat Eye Syndrome region, clone:N64E9," XP002359991, retrieved from EBI accession No. EM_PRO:AP000526, database accession No. AP000526 for SEQ ID No. 40.
Database EMBL 'Online! Oct. 28, 1998, "*Homo sapiens* neurexin III-alpha gene, partial cds," XP002359992, retrieved from EBI accession No. EM_PRO:AF099810, database accession No. AF099810 for SEQ ID No. 43.
Database EMBL 'Online! Jan. 25, 2001, "QV2-NN0045-081200-535-c10 NN0045 *Homo sapiens* cDNA, mRNA sequence." XP002359993 retrieved from EBI accession No. EM_PRO:BF960930, database accession No. BF960930 for SEQ ID No. 43.
Database EMBL 'Online! Sep. 29, 1999, *Homo sapiens* genomic DNA, chromosome 22q11.2, Cat Eye Syndrome region, clone:N14H11, XP002359994 retrieved from EBI accession No. EM_PRO:AP000525, database accession No. AP000525 for SEQ ID No. 44.
Database EMBL 'Online! Mar. 19, 1998, CIT-HSP-2172C8.TF CIT-HSP *Homo sapiens* genomic clone 2172C8, genomic survey sequence, XP002359995 retrieved from EBI accession No. EM_PRO:B92131, database accession No. B92131 for SEQ ID No. 44.
Database EMBL 'Online! Sep. 29, 1999, "*Homo sapiens* genomic DNA, chromosome 22q11.2, Cat Eye Syndrome region, clone:c91G6," XP002359996 retrieved from EBI accession No. EM_PRO:AP000528, database accession No. AP000528 for SEQ ID No. 45.
Database EMBL 'Online! Mar. 15, 1999, "*Homo sapiens* chromosome UNK clone CTA-435J10, working draft sequence, 1 unordered pieces," XP002359997 retrieved from EBI accession No. EM_PRO:AC007044, database accession No. AC007044 for SEQ ID No. 61.

\* cited by examiner

Fig. 3 Proportion of clones over-expressing luciferase

Fold over-expression by over-expressing clones: minimum and median

Fig. 5 Fold over-expression by over-expressing clones: maximum

Vector for testing STAR activity

FIG 13
STAR element orientation
A. pSelect vector with cloned STAR element:
B. pSDH vector, STARs in native orientation:
C. pSDH vector, STARs in opposite orientation:

Directionality of STAR function

STAR copy number dependency

Vector for SINC element screening

Vector for SINC element testing

Schematic Diagram of STAR Element Bioinformatic Analysis

Classification of STARs by Discriminant Analysis with Oligo and Dyad Models

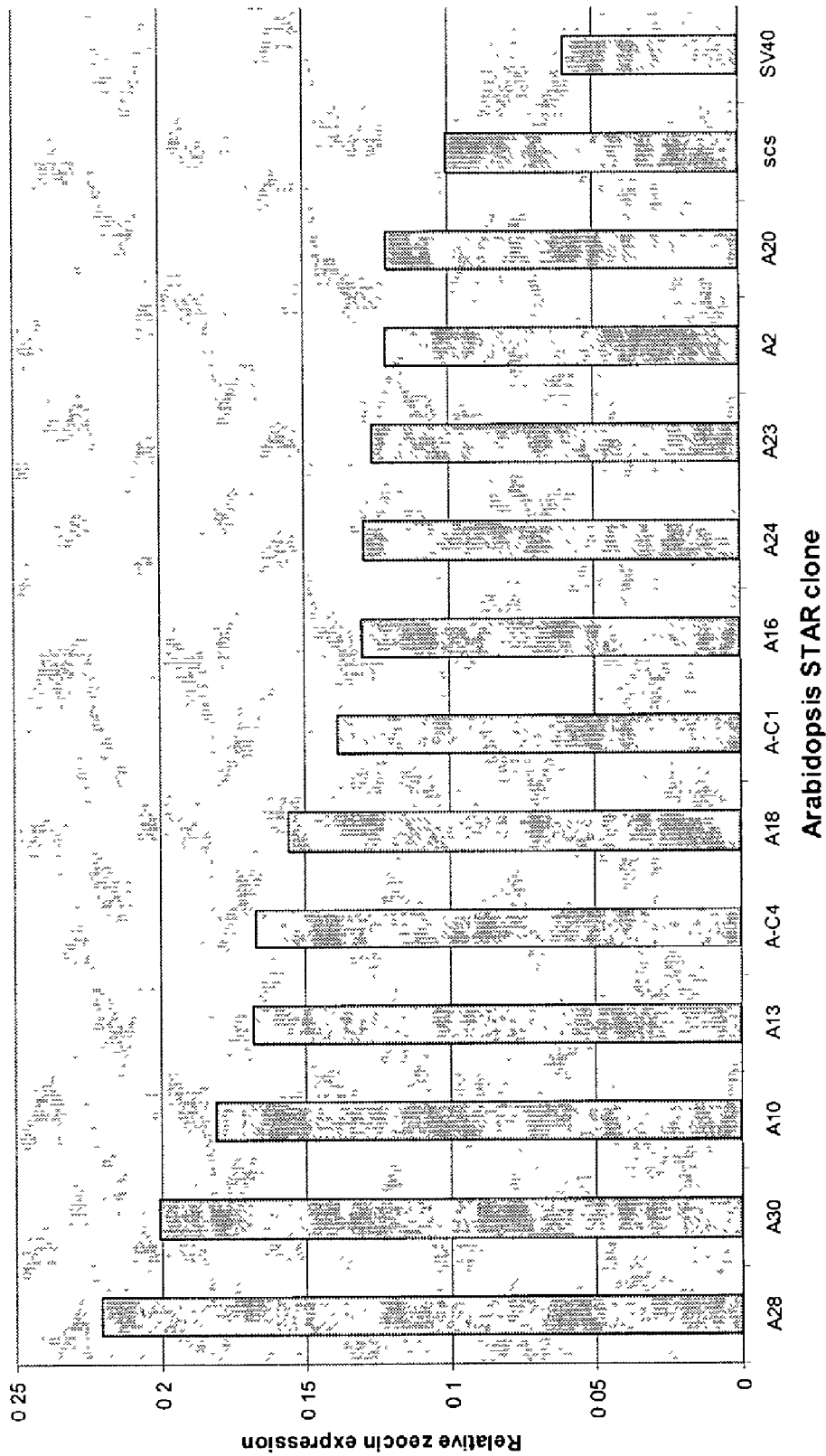

FIG. 26 (CONT)

SEQ ID:1
>STAR1
ATGCGGTGCCGGCGCGCCAGAGACTCGTGGGATCCTTGGCTTGGATGTTTGGATCTTTCTGAGTTGCCTGTGCCGCGAA
AGACAGGTACATTTCTGATTAGGCCTGTGAAGCCTCCTGGAGGACCATCTCATTAAGACGATGGTATTGGAGGGAGAGT
CACAGAAAGAACTGTGGCCCCTCCCTCACTGCAAAACGGAAGTGATTTTATTTTAATGGGAGTTGGAATATGTGAGGGC
TGCAGGAACCAGTCTCCCTCCTTCTTGGTTGGAAAAGCTGGGGCTGGCCTCAGAGACAGGTTTTTTGGCCCCGCTGGGC
TGGGCAGTCTAGTCGACCCTTTGTAGACTGTGCACACCCCTAGAAGAGCAACTACCCCTATACACCAGGCTGGCTCAAG
TGAAAGGGGCTCTGGGCTCCAGTCTGGAAAATCTGGTGTCCTGGGGACCTCTGGTCTTGCTTCTCTCCTCCCCTGCACT
GGCTCTGGGTGCTTATCTCTGCAGAAGCTTCTCGCTAGCAAACCCACATTCAGCGCCCTGTAGCTGAACACAGCACAAA
AAGCCCTAGAGATCAAAAGCATTAGTATGGGCAGTTGAGCGGGAGGTGAATATTTAACGCTTTTGTTCATCAATAACTC
GTTGGCTTTGACCTGTCTGAACAAGTCGAGCAATAAGGTGAAATGCAGGTCACAGCGTCTAACAAATATGAAAATGTGT
ATATTCACCCCGGTCTCCAGCCGGCGCGCCAGGCTCCC

SEQ ID:2
>STAR2
GGGTGCTTCCTGAATTCTTCCCTGAGAAGGATGGTGGCCGGTAAGGTCCGTGTAGGTGGGGTGCGGCTCCCCAGGCCCC
GGCCCGTGGTGGTGGCCGCTGCCCAGCGGCCCGGCACCCCCATAGTCCATGGCGCCCGAGGCAGCGTGGGGGAGGTGAG
TTAGACCAAAGAGGGCTGGCCCGGAGTTGCTCATGGGCTCCACATAGCTGCCCCCCACGAAGACGGGGCTTCCCTGTAT
GTGTGGGGTCCCATAGCTGCCGTTGCCCTGCAGGCCATGAGCGTGCGGGTCATAGTCGGGGGTGCCCCCTGCGCCCGCC
CCTGCCGCCGTGTAGCGCTTCTGTGGGGGTGGCGGGGGTGCGCAGCTGGGCAGGGACGCAGGGTAGGAGGCGGGGGGCA
GCCCGTAGGTACCCTGGGGGGGCTTGGAGAAGGGCGGGGGCGACTGGGGCTCATACGGGACGCTGTTGACCAGCGAATG
CATAGAGTTCAGATAGCCACCGGCTCCGGGGGGCACGGGGCTGGGACTTGGAGACTGGCCCCCCGATGACGTTAGCATG
CCCTTGCCCTTCTGATCCTTTTTGTACTTCATGCGGGCGATTCTGGAACCAGATCTTGATCTGGCGCTCAGTGAGGTTCA
GCAGATTGGCCATCTCCACCCGGCGCGGCCGGCACAGGTAGCGGTTGAAGTGGAACTCTTTCTCCAGCTCCACCAGCTG
CGCGCTCGTGTAGGCCGTGCGCGCGCGCTTGGACGAAGCCTGCCCCGGCGGGCTCTTGTCGCCAGCGCAGCTTTCGCCT
GCGAGGACAGAGAGAGGAAGAGCGGCGTCAGGGGCTGCCGCGGCCCCGCCCAGCCCCTGACCCAGCCCGGCCCCTCCTT
CCACCAGGCCCCAA

SEQ ID:3
>STAR3
ATCTCGAGTACTGAAATAGGAGTAAATCTGAAGAGCAAATAAGATGAGCCAGAAAACCATGAAAAGAACAGGGACTACC
AGTTGATTCCACAAGGACATTCCCAAGGTGAGAAGGCCATATACCTCCACTACCTGAACCAATTCTCTGTATGCAGATT
TAGCAAGGTTATAAGGTAGCAAAAGATTAGACCCAAGAAAATAGAGAACTTCCAATCCAGTAAAAATCATAGCAAATTT
ATTGATGATAACAATTGTCTCCAAAGGAACAAGGCAGAGTCGTGCTAGCAGAGGAAGCACGTGAGCTGAAAACAGCCAA
ATCTGCTTTGTTTTCATGACACAGGAGCATAAAGTACACACCACCAACTGACCTATTAAGGCTGTGGTAAACCGATTCA
TAGAGAGAGGTTCTAAATACATTGGTCCCTCACAGGCAAACTGCAGTTCGCTCCGAACGTAGTCCCTGGAAATTTGATG
TCCAGTATAGAAAAGCAGAGCAGTCAAAAAATATAGATAAAGCTGAACCAGATGTTGCCTGGGCAATGTTAGCAGCACC
ACACTTAAGATATAACCTCAGGCTGTGGACTCCCTCCCTGGGGAGCGGTGCTGCCGGCGGCGGGGCGGGCTCCGCAACTC
CCCGGCTCTCTCGCCCGCCCTCCCGTTCTCCTCGGGCGGCGGCGGGGCCGGGACTGCGCCGCTCACAGCGGCGGCTCT
TCTGCGCCCGGCCTCGGAGGCAGTGGCCGGTGGCGGCCATGGCCTCCTGCGTTCGCCGATGTCAGCATTTCGAACTGAGG
GTCATCTCCTTGGGACTGGTTAGACAGTGGGTGCAGCCCACGAGGGCGAGTTGAAGCAGGGTGGGGTGTCACCTCCCC
CAGGAAGTCCAGTGGGTCAGGGAACTCCCTCCCCTAGCCAAGGGAGGCCGTGAGGGACTGTGCCGGTGAGAGACTGTG
CCCTGAGGAAAGGTGCACTCTGGCCCAGATACTACACTTTTCCCACGGTCTTCAAAACCCGCAGACCAGGAGATTCCCT
CGGGTTCCTACACCACCAGGACCCTGGGTTTCAACCACAAAACCGGGCCATTTGGGCAGACACCCAGCTAGCTGCAAGA
GTTGTTTTTTTTTTTATACTCCTGTGGCACCTGGAACGCCAGCGAGAGAGCACCTTTCACTCCCCTGGAAAGGGGCTG
AAGGCAGGGACCTTTAGCTGCGGGCTAGGGGGTTTGGGGTTGAGTGGGGGAGGGGAGGGGAAAAGGCCTCGTCATTGG
CGTCGTCTGCAGCCAATAAGGCTACGCTCCTCTGCTGCGAGTAGACCCAATCCTTTCCTAGAGGTGGAGGGGGCGGGTA
GGTGGAAGTAGAGGTGGCGCGGTATCTAGGAGAGAGAAAAGGGCTGGACCAATAGGTGCCCGGAAGAGGCGGACCCAG
CGGTCTGTTCATTGGTATTGGCAGTGGACCCTCCCCGGGGTGGTGCCGGAGGGGGGATGATGGGTCGAGGGGTGTGT
TTATGTGGAAGCGAGATGACCGGCAGGAACCTGCCCCAATGGGCTGCAGAGTGGTTAGTGAGTGGGTGACAGACAGACC
CGTAGGCCAACGGGTGGCCTTAAGTGTCTTTGGTCTCCTCCAATGGAGCAGCGGCGGGGCGGGACCGCGACTCGGGTTT
AATGAGACTCCATTGGGCTGTAATCAGTGTCATGTCGGATTCATGTCAACGACAACAACAGGGGGACACAAAATGGCGG
CGGCTTAGTCCTACCCCTGGCGGCGGCGGCAGCGGTGGCGGAGGCGACGGCACTCCTCCAGGCGGCAGCCGCAGTTTCT
CAGGCAGCGGCAGCGCCCCCGGCAGGCGCGGTGGCGGTGGCGCGCAGCCAGGTCTGTCACCCACCCCCGCGTTCCCAG
GGGGAGGAGACTGGGCGGGAGGGGGGAACAGACGGGGGGGATTCAGGGGCTTGCGACGCCCCTCCCACAGGCCTCTGC
GCGAGGGTCACCGCGGGGCCGCTCGGGGTCAGGCTGCCCCTGAGCGTGACGGTAGGGGGCGGGGGAAAGGGGAGGAGGG
ACAGGCCCCGCCCCTCGGCAGGGCCTCTAGGGCAAGGGGGCGGGGCTCGAGGGAGCGGAGGGGGGCGGGGCGG

SEQ ID:4
>STAR4
GATCTGAGTCATGTTTTAAGGGGAGGATTCTTTTGGCTGCTGAGTTGAGATTAGGTTGAGGGTAGTGAAGGTAAAGGCA
GTGAGACCACGTAGGGGTCATTGCAGTAATCCAGGCTGGAGATGATGGTGGTTCAGTTGGAATAGCAGTGCATGTGCTG
TAACAACCTCAGCTGCCAAGCAGTATATGTGGCGTTATGACCTCAGCTGGAACAGCAATGCATGTGGTGGTGTAATGAC

FIG. 26 (CONT)

```
CCCAGCTGGGTAGGGTGCATGTGGTGTAACGACCTCAGCTGGGTAGCAGTGTGTGTGATGTAACAACCTCAGCTGGGTA
GCAGTGTACTTGATAAAATGTTGGCATACTCTAGATTTGTTATGAGGGTAGTGCCATTAAATTTCTCCACAAATTGGTT
GTCACGTATGAGTGAAAAGAGGAAGTGATGGAAGACTTCAGTGCTTTTGGCCTGAATAAATAGAAGACGTCATTTCCAG
TTAATGGAGACAGGGAAGACTAAAGGTAGGGTGGGATTCAGTAGAGCAGGTGTTCAGTTTTGAATATGATGAACTCTGA
GAGAGGAAAAACTTTTTCTACCTCTTAGTTTTTGTGACTGGACTTAAGAATTAAAGTGACATAAGACAGAGTAACAAGA
CAAAAATATGCGAGGTTATTTAATATTTTTACTTGCAGAGGGGAATCTTCAAAAGAAAAATGAAGACCCAAAGAAGCCA
TTAGGGTCAAAAGCTCATATGCCTTTTTAAGTAGAAAATGATAAATTTTAACAATGTGAGAAGACAAAGGTGTTTGAGC
TGAGGGCAATAAATTGTGGGACAGTGATTAAGAAATATATGGGGGAAATGAAATGATAAGTTATTTTAGTAGATTTATT
CTTCATATCTATTTTGGCTTCAACTTCCAGTCTCTAGTGATAAGAATGTTCTTCTCTTCCTGGTACAGAGAGAGCACCT
TTCTCATGGGAAATTTTATGACCTTGCTGTAAGTAGAAAGGGGAAGATCGATCTCCTGTTTCCCAGCATCAGGATGCAA
ACATTTCCCTCCATTCCAGTTCTCAACCCCATGGCTGGGCCTCATGGCATTCCAGCATCGCTATGAGTGCACCTTTCCT
GCAGGCTGCCTCGGGTAGCTGGTGCACTGCTAGGTCAGTCTATGTGACCAGGAGCTGGGCCTCTGGGCAATGCCAGTTG
GCAGCCCCCATCCCTCCACTGCTGGGGGCCTCCTATCCAGAAGGGCTTGGTGTGCAGAACGATGGTGCACCATCATCAT
TCCCCACTTGCCATCTTTCAGGGGACAGCCAGCTGCTTTGGGCGCGGCAAAAAACACCCAACTCACTCCTCTTCAGGGG
CCTCTGGTCTGATGCCACCACAGGACATCCTTGAGTGCTGGGCAGTCTGAGGACAGGGAAGGAGTGATGACCACAAAAC
AGGAATGGCAGCAGCAGTGACAGGAGGAAGTCAAAGGCTTGTGTGTCCTGGCCCTGCTGAGGGCTGGCGAGGGCCCTGG
GATGGCGCTCAGTGCCTGGTCGGCTGCAAGAGGCCAGCCCTCTGCCCATGAGGGGAGCTGGCAGTGACCAAGCTGCACT
GCCCTGGTGGTGCATTTCCTGCCCCACTCTTTCCTTCTAAGATCC

SEQ ID:5
>STAR5
AGCAGAGATCTTATTTCCCGTATTCCCTTGTGGCACAGCACCTCCCACGCCAAAGCAAACCAAAGCAAAGGAGCCCTTG
ATGAGGAGGGGCCTTCCCCCAACCTGGTCTCCCACAGGTCCTACATACGTACCCACCCCAGACACACAGAGCTGCTTCC
TGCTCTCACACCAGACTGAGCTGTGCCCAGACATTTCCCCTAGCACTAACCAACTCTTTCAAAAATACATTTTTCTCTA
AAAAGAACAAGTTTAAACAAAGTTGACTCATTTTAAGAACTGTTTAGAAGATAACCTTGTGTTTATTAATTATGTATTT
GCAGAAATTGGAGGCAGAAGGTTACCAACATTGCCTGGTGTCCAGCCAGGAGGTAGAGCGTGGTGGCATCCAGAACCTT
CCTCCAACTCCTGCCTGGCGTGGTTTTTATTCATCTTTGTATTCCCAAGAAACTTCTCAGTGTCTCAGGAGTGTTACGC
ACTCAGTACGTGTTTGGTAGTTACATGAATGAATGCATAATGACTAAGTGAGTTAATGGATGAAGCTAATTGTCTCTCC
CTTTTGCTTTTCCAGAGCTTTCCAAGGTCAAAGTGTTGGACACTCTTTCTTCATCTCAGATTTAATCAACTAAGAATGC
TGCAAATTGAACACCAGTCCACAAAACTCAGGAATACATGAAAAGCATTGTGCCTTATTTTTAACTAACTCAAATTCTA
TGTCAGTCTCCCTTTTATGCTGGATGTTGGCGCTAAATCTCAGTGGGTTCCTCATTCTGCCAGACCTGTGTCCAGTTTG
GGGGCTTCACATAGAGCCACCCCATCACAGGAGAGGGAAGGGTCTTGCTCTTGGTTGCCATCACTCCACCCTCTTGTCT
TCCGAGCTTTGATGTTCACTTTCCTTTTCACCACTCGGAAGCTTCCTGCCATGATACATTGAGACCTCAATGTTAATGC
CAATTGGGGTTTGGGGTTCTCATAAACTCAGAAGTCCAGGAAAATCGCCTGCTGCCTCCCACAACACTCTGAGGGCATT
CTGGAATCCTACCACTTACCTGGAGCCTGCTGGCCTCAACTGTTTTGAAGTCTGTGTCTGGGCCATGCAGGTAAATGGG
AGGATGTTCTGTGGCCATAAAAATACCCGAAGTCCCACCTAAAGTTGATGCAGGGTCTTCTGCATTTCATTGCAAAATT
GTTCTATCATTTCTATAGTTTTCAGCCTACAGTCAGGGGCCAGGACTTTGCACCCTTGGTAAACCTCAATCTCTTCTCC
TTCCTGGCTTCTACTCCTTTCTCCCTCAATCCCAAATCAAGGCCCTTGATTGTCTGGAGGTAGGAAAGCCTGGTTCTGG
CTCATGATATAGTCTACATCATAGCCTTTGTCATCTCAGGATTCACTCAACAACCGTGTGTGGATGGGGCCACCCAAT
ATGTGCCAGGAGTTGAGGACACGCAGGGTTATGATGATGAAATAGATAAGGGGCCCACACTCACGGACCCTGCAGGACA
GTGGAGCTGTGGACCCAGCATGCGAGTAAAGACCCAGTGAGCTCACCAGACAGATCATTTAAATCAGGTG

SEQ ID:6
>STAR6
TGACCCACCACAGACATCCCCTCTGGCCTCCTGAGTGGTTTCTTCAGCACAGCTTCCAGAGCCAAATTAAACGTTCACT
CTATGTCTATAGACAAAAAGGGTTTTGACTAAACTCTGTGTTTTAGAGAGGGGAGTTAAATGCTGTTAACTTTTTAGGGG
TGGGCGAGAGGGATGACAAATAACAACTTGTCTGAATCTTTTACATTTCTCCCCACTGCCTCAAGAAGGTTCACAACGA
GGTCATCCATGATAAGGAGTAAGACCTCCCAGCCGGACTGTCCCTCGGCCCCAGAGGACACTCCACAGAGATATGCTA
ACTGGACTTGGAGACTGGCTCACACTCCAGAGAAAAGCATGGAGCACGAGCGCACAGAGCAGGGCCAAGGTCCCAGGGA
CAGAATGTCTAGGAGGGAGATTGGGGTGAGGGTAATCTGATGCAATTACTGTGGCAGCTCAACATTCAAGGGAGGGGGA
AGAAAGAAACAGTCCCTGTCAAGTAAGTTGTGCAGCAGAGATGGTAAGCTCCAAAATTTGAAACTTTGGCTGCTGGAAA
GTTTTAGGGGGCAGAGATAAGAAGACATAAGAGACTTTGAGGGTTTACTACACACTAGACGCTCTATGCATTTATTTAT
TTATTATCTCTTATTTATTACTTTGTATAACTCTTATAATAATTTATGAAAACGGAAACCCTCATATACCCATTTTAC
AGATGAGAAAAGTGACAATTTTGAGAGCATAGCTAAGAATAGCTAGTAAGTAAAGGAGCTGGGACCTAAACCAAACCCT
ATCTCACCAGAGTACACACTCTTTTTTTTTTCCAGTGTAATTTTTTTAATTTTTATTTTACTTTAAGTTCTGGGATA
CATGTGCAGAAGGTATGGTTTGTTACATAGGTATATGTGTGCCATAGTGGATTGCTGCACCTATCAACCCGTCATCTAG
GTTTAAGCCCCACATGCATTAGCTATTTGTCCTGATGCTCTCCCTCCCCTCCCCACACCAGACAGGCCTTGGTGTGTGA
TGTTCCCCTCCCTGTGTCCATGTGTTCTCACTGTTCAGCTCCCACTTATGAGTGAGAACGTGTGGTATTTGGTTTTCTG
TTCCTGTGTTAGTTTGCTGAGGATGATGGCTTCCAGCTTCATCCATGTCCCTGCAAAGGACACGATC

SEQ ID:7
>STAR7
ATCATGCCAGCTTAGGCGACAGAGTGAGACTGGACATAATAACAATAATAATAAAAATAAATAAATAAAACAATTATCT
```

FIG. 26 (CONT)

```
GAGAGGAAAAATTTGATTCATAATAAAGAGAATAAAGGTTTTTGGCGTGTTTGTTTTGTTTTCACCTAAGAACAGCTGT
TCCCCTCATTGGGTTAGTTTTATTTGCAAGCAGAAATCATCTCCGCATGATTTCCAGGGTGATGGAAAACTGAATATGA
ATCCACCTTCTGCCATCTATTCACTTGTCACATTTAATAAGACACTCATGCCTATTTTAGCATGTTTTCTTCCCTACCA
AATGAGTTAGTAACATCAAGAGATTAAAATAACACAAATAAGAACATTGAAGGTATTCAAATGTTACATACAAATATTA
AACACAATATTATTATAATTATTCCTGGAAATGACATTGCCTCTACTCTCAAGGTAAAGGTCATTTTTCTTGATTTAAA
CTTTTTTCTCAAGTTTGAAATCTCTAAGTTTCAACCCGTAATCTATTTGCAAGTTTGTGCAAATTTTAGGGATTGAATC
CATAGTAATTAGTGATTTATTGTGGTGTAGGGAGACAAGTCAAAAGAATCAGGACTGCTAGGTAGATGACTAAGGAAAG
GATGGTTCACGAGGTGACATAAAGCACTCAGAAGAAAAAGGTCAGGAAACGGAGGACAGAAAAAAACCTAAGTTCTGCT
GGGTGATGCTGAATTTGTCATCACAAAATCTGCATTGTGGAAGCTTTAGCTATTGAGGAGATTGCTCAAGTGTAGAACT
GAGAACAATAGGCAGTGAACCCGAGAGAACATCAAGAGACTGAGAGAAAATGAACCAGACTTCCAGGTGCTCCATGTTC
CAACCAACATTTTGTATTGTCAGAAGGAATTGAGAGGCAAAAGGAAACCCAATAAAAAATAAAACAGGAAGGGCATAC
ATGATTACCACCCCTTTTCTCACCAGCTGCTCATGGACCAGCTTTCTCCTAGTGCTATTTTCTTGGTCACTGCATCACT
CTGCTAACATAGTTTCCCCACTAGCTCTGAGGCTGTCCCAGAGGGGAAGCCAGCTGTCATCTCCTTCTTCCACACTCTG
TTGGAGGAACCTGTCATTAGCAGCTCCCTACTAAACGCATTTATGACAAACAGGCAGGAGATAATTAACTAGAAAGTGA
ACAAACTCAAACTTCAGAGCCTCTCATTTGTATGAATGCCCTTGTAAGGTCTTGGGCCTATTTTAATATTTATAAATGT
GTTATTTTCTTCTAAAGAAAACCACCAAATTGTATAAGCTACAGAATCTGCAAAACTGAGGTCCATCCATGCACTCAGG
ATACATTCATAGCATCTCTGAGCTGGAAAATATCTTAAAGGTCATATATGTCCTCCAACACTGCAAGAATCTCTCTGGC
AGCATTCTTTTAAAATCATCATCTAAAGAGGGAAATCCCCAGCTGTGTTTGATTTTGCTCTGTCACTTGTCCAGTTT
CCCCATCCATAAAAGGGCAACAATATGAATTTCCTGATAAGGTAGTTGTTAATATAAATACAAAGTGCGTAGCCACTTC
CCTAAGAAAAATATGGGGTTTCTGCTTCACAGTCTAGGGAGAGGAAAAAAAAGGGGGGTCAGAAGTGATTATTATTATC
ATTCTATATTGGAATGTTTTCAGACATAAAAAGCTCACCACGTCTTAGGCCAGACAGATGCATTATGAAAGTTAAGCTA
AGTCTTCCTCATCATGAGCTGCACCTATATCCCCATTACTTCTTCTAGAACTGCATAATTTATTTATTCTTTCTTCAAA
AGTTTGACAGAGCCATTCTTGTCCTCTAAGATTTTTTTTTTTTTTTTGGAGACAGAGTCTCCGTCTGTTGCCCAGGCT
GGAGTGCAATGGCACTATCTCAGCTCACTGCAACCTCTGCCTCCCAGATTCAAGTGATTCTCCTGCCTCAGCCTCCCGA
GTAGCTGGGATTACAAGCACGCACCACCACAACCAGCTAATTTTTCGTATTTTTTAGTAGAGACGAGGTTTTACCATGT
TGGCCAGGCTGGTCTTGAACTCCTGACCTCGGGTGATCCACCCACCT

SEQ ID:8
>STAR8
GAGATCACCTCGAAGAGAGTCTAACGTCCGTAGGAACGCTCTCGGGTTCACAAGGATTGACCGAACCCCAGGATACGTC
GCTCTCCATCTGAGGCTTGCTCCAAATGGCCCTCCACTATTCCAGGCACGTGGGTGTCTCCCCTAACTCTCCCTGCTCT
CCTGAGCCCATGCTGCCTATCACCCATCGGTGCAGGTCCTTTCTGAAGAGCTCGGGTGGATTCTCTCCATCCCACTTCC
TTTCCCAAGAAAGAAGCCACCGTTCCAAGACACCCAATGGGACATTCCCCTTCCACCTCCTTCTCCAAAGTTGCCCAGG
TGTTCATCACAGGTTAGGGAGAGAAGCCCCCAGGTTTCAGTTACAAGGCATAGGACGCTGGCATGAACACACACACACA
CACACACACACACACACACACACACACGACTCGAAGAGGTAGCCACAAGGGTCATTAAACACTTGACGACTGTTTTC
CAAAAACGTGGATGCAGTTCATCCACGCCAAAGCCAAGGGTGCAAAGCAAACACCGAATGGTGGAGAGATTCCAGAGGC
TCACCAAACCCTCTCAGGAATATTTTCCTGACCCTGGGGGCAGAGGTTGGAAACATTGAGGACATTTCTTGGGACACAC
GGAGAAGCTGACCGACCAGGCATTTTCCTTTCCACTGCAAATGACCTATGGCGGGGGCATTTCACTTTCCCCTGCAAAT
CACCTATGGCGAGGTACCTCCCCAAGCCCCCACCCCCACTTCCGCGAATCGGCATGGCTCGGCCTCTATCCGGGTGTCA
CTCCAGGTAGGCTTCTCAACGCTCTCGGCTCAAAGAAGGACAATCACAGGTCCAAGCCCAAAGCCCACACCTCTTCCTT
TTGTTATACCCACAGAAGTTAGAGAAAACGCCACACTTTGAGACAAATTAAGAGTCCTTTATTTAAGCCGGCGGCCAAA
GAGATGGCTAACGCTCAAAATTCTCTGGGCCCCGAGGAAGGGCTTGACTAACTTCTATACCTTGGTTTAGGAAGGGGA
GGGGAACTCAAATGCGGTAATTCTACAGAAGTAAAAACATGCAGGAATCAAAAGCAAATGGTTATAGAGAGATAAA
CAGTTTTAAAAGGCAAATGGTTACAAAAGGCAACGGTACCAGGTGCGGGCTCTAAATCCTTCATGACACTTAGATATA
GGTGCTATGCTGGACACGAACTCAAGGCTTTATGTTGTTATCTCTTCGAGAAAAATCCTGGGAACTTCATGCACTGTTT
GTGCCAGTATCTTATCAGTTGATTGGGCTCCCTTGAAATGCTGAGTATCTGCTTACACAGGTCAACTCCTTGCGGAAGG
GGGTTGGGTAAGGAGCCCTTCGTGTCTCGTAAATTAAGGGGTCGATTGGAGTTTGTCCAGCATTCCCAGCTACAGAGAG
CCTTATTTACATGAGAAGCAAGGCTAGGTGATTAAAGAGACCAACAGGGAAGATTCAAAGTAGCGACTTAGAGTAAAAA
CAAGGTTAGGCATTTCACTTTCCCAGAGAACGCGCAAACATTCAATGGGAGAGAGGTCCCGAGTCGTCAAAGTCCCAGA
TGTGGCGAGCCCCCGGGAGGAAAAACCGTGTCTTCCTTAGGATGCCCGGAACAAGAGCTAGGCTTCCGGAGCTAGGCAG
CCATCTATGTCCGTGAGCCGGCGGGAGGGAGACCGCCGGGAGGCGAAGTGGGGCGGGGCCATCTTCTTTCTGCTCTGC
TGCTGCCGGGGAGCTCCTGGCTGGCGTCCAAGCGGCAGGAGGCCGCCGTCCTGCAGGGCGCCGTAGAGTTTGCGGTGCA
GAGT

SEQ ID:9
>STAR9
ATGAGCCCCCAAAAATGATCCTCTGGCTTATGACAACCTGATGCAGCCCAGGAAATGCCTGCAACATGCCCACTAGCAG
CTGGGAACCCCTCTGTGAGGAAGAGAACGTTTTACATTAAGAAACCCTTTGTTTTGCAGCAGAGACTATTCAGGTCACA
CATGTGTGGCCTCTCAGTTCTTTGAGCCATTTGAAGTTCTCTATCCTTGCTGGGAGGCTGAGCTCTCCATGGAAACCTG
GTCCGATAGTGAGAGGAGCAGACCCTCTGGAAACACCTTTTTACACCTGACCAAAGCAGCCAGTCATGGGCCAGTGATG
CAACAAGGTCAACCGGTGCATTCTGGCCCCTCAGAAAAGCAGCCCCGGGAAGGTCAGGAGGAGGCTGCTGACTCCCTC
TTCCCCTGCAGCCGCCCCAAGCACACCCAGGAGCCCTGCAGGTTTGGGTTCACCAGGTGCCAGCAGGTCCCACGATGCT
GCATTTCTTACGAGCTCCTGGAGGATGCAGATGGTCCTGGTCAGAGGCTGCATTCTGAGTATCAGGAGCCATGGGGCAA
```

FIG. 26 (CONT)

CGTTTCTGCGATTGAGGAAGGGGCATTTCTGGGGTGGGCAGAACAAAGGTCTTTGGCTGAGCTGGAGCATCCGCCTCCA
TCAGTGTTTTCCGGCAACTGTACTATCCATCGTCTTCCCTTCCCACAGCTGACCATGGCTTTGGAAAATGCTCTGAAAC
TTTCTTTTCAGAAGAGTTGACTCCCAACTCCACACTTAGGGGAAGTCAAGCCTACTTCTCAGAATTCAGAGAAGGCATA
AAAAAGAATTCATTTCTAAAGGCCCTTTAGAAGTAACTTCAGGTCTGACAGCGGCCAGCTAATTTCTGGTCGCCTTCCA
GGAATCTTCTGACTGCAAAAAAAAAGCATTTACCACCTGAACACAAACCCAGTTACAGATAGAAAAACATAGTCATTTA
AATAGAATATAAGCATCTGGCCTCTGCCCATCATAATGGAGTAACACAAAAATCTATTTTCAAAAGGAAACTAAATATT
ATTGACCAAAACATGAATGGGGAGACCTCAGGGTGATACAGCTCTTGCCTGGATGGAATTTGTAATCAAGAGGATGAGA
CAGGATTGTAACTTGTGCCAATGTGAAAGGGTTTGCTCAGGTATCATTCATTTTGCTTAAATGCATGGGTAATTTCCAA
AGTTCTTTGGAGCTGAATTTCACAATTTAGTGCAGGTCCTGGTGAGCCCACCTTGACTTATCTCACAGTACAATGCAGT
GGCGTGGCTACAATGCTGGGCAAGAGAAGCCAATGTCAACAGCCCAGGAGTGGCTGGGTCCTTACCAGGCTCCCAGGCA
TGCTTCATGGTGGGCCCTGGGCTGGGAGGAACAGCACCTTTGCCTGGTCCATGAGTATCTGGGTCAAACTCTCCTGTGG
ACACAGAAGGCCATGGCGACAGGCATTCCCAGGAAAAGAAAAGGGCAGCAGCTGAAATCGTCAGGTGGAGAAGGCAGTC
ATCCTTGCTCAGTCAACTCTAATCCGGCTGCCTCCTCCTCAGCTTCAGGGTGAACCTCTCCTAAGCTGTGTCTTTGGTA
TCTGATGGGCATTAGGTGCTGGTGAAAAAGCTGGAGGGTCCTTTGGGATATTACAGAAGCCCAATCTAGCCTTGTATTC
AATATCTAGGCACTCTCACCCCTGAAGTTCTACGTTTCCAGATTTCTGAAAACATGGGAAAGCATGTGTGTGATGTCTG
AGGTCCCCCTCAGCCTCTGGTGTAGGGTTAGGAGGGCTCTAAAGGGTGGCAGCTCCAGTGTCCCAGTGGGGCCTGAAGT
TGGTCCCTTCCCTTCCCAGCTCCCATCCATGGTTTAGCCCAATCCCTTCCGTACCTAAGAGTACTGCACATGGATGCTC
CACGCAGAGCCTCTGCTCCACTCCCAGGAAGTG

SEQ ID:10
>STAR10
AGGTCAGGAGTTCAAGACCAGCCTGGCCAACATGGTGAAACCCTGTCCCTACAAAAAATACAAAAATTAGCCGGGCGTG
GTGGGGGGCGCCTATAATCCCAGCTACTCAGGATGCTGAGACAGGAGAATTGTTTGAACCCGGGAGGTGGAGGTTGCAG
TGAACTGAGATCGCGCCACTGCACTCCAGCCTGGTGACAGAGAGAGACTCCGTCTCAACAACAGACAAACAAACAAACA
AACAACAACAAAATGTTTACTGACAGCTTTATTGAGATAAAATTCACATGCCATAAAGGTCACCTTCTACAGTATACA
ATTCAGTGGATTTAGTATGTTCACAAAGTTGTACGTTGTTCACCATCTACTCCAGAACATTTACATCACCCCTAAAACA
AGCTCTTTAGCAGTCACTTCTCATTCTCCCCAGCCCCTGCCAACCACGAATCTACTNTCGTCTCTATTCTGAATATTT
CATATAAAGGAGTCCTATCATATGGGCCTTTTACGTCTACCTTCTTTCACTTAGCATCATGTTTTTAAGATTCATCCAC
AGTGTAGCACGTGTCAGTTAATTCATTTCATCTTATGCTGGATAATGCTCTATTGTATGCATATCCCTCACTTTGCTT
ATCCATTCATCAACTGATTGACATTTGGGTTATTTCTACTTTTTGACTATTATGAGTAATGCTGCTATGAACATTCCTG
TACCAATCGTTACGTGGACATATGCTTTCAATTCTCCTGAGTATGTAACTAGGGTTGGAGTTGCTGGGTCATATGTTAA
CTCAGTCTTTCATTTTTTGAAGAACTACCAAATGGTTTTCCAAAGTGGATGCAACACTTTACATTCCCACCAGCAAGA
TATGAAGGTTCCAATGTCTCTACATTTTTGCCAACACTTGTGATTTTCTTTTATTTATTTATTTATTTATTTTTG
AGATGGAGTCTCACTCTGTCACCCAGGCTGGAGTGCAGTGGCACAATTTCAGCTCACTGCAATCTCCACCTCTCGGGCT
CAAGCGATACTCCTGCCTCAACCTCCCGAGTAACTGGGATTACAGGCGCCCACCACCACACCAAGCTAATTTTTTGTAT
TTTTAGTAGAGACGGGGTTTCATCATGTCGGCCAGGNTGTACTCGAACTCTGACCTCAAGT

SEQ ID:11
>STAR11
GATTCTGGGTGGGTTTGATGATCTGAGAGTCCCTTGAATAAAAAGAATTCTAGAAAAGCTGTGAAACTTCACCTTTCCC
CTATTCTTAACCTTACTTGCCTTTGGGAGGCTGAGGCAGGAGGATGACTTAAGGCCAGGAGTTTGAGAATGTAGTGAGC
TATGACCACACCGGTTACACTCAAGCCTGGGCGAGACCACAACAAAAACCTTACCTGCCAACTGCTCCATGCTGGAAAT
TTATTTCGTTTCTTGGATTGTGGAAAGAACTGGCTTACTGAAAACCACACTTCTCTAAAACCCTTCTTCCAGTTAGGTG
TTAAGATTTTAACAGCCTTTCCTATCTGAATAAAAACTGCACACAAAGTAAACTTAAGAGATGTCAACAACTCATCTGT
TTGTTACAAGATGAGTCTCCATGCTTCATCGCCTGTGGGGAATCCTCATCAGCGTCTAGTGGCAAAGACTCCTGTGTGC
TCACCGAAACGCTCCCCTTCCTCCAGCGCACACAGTCACATGGATTTCCCATGCACCCTGGCAGCTCAGCAGGAGTCCA
TGACTTAAGAAGGCCAATGGACTGTGGGTGAAGTCTGTGGACGGGGAAGCCACATGCGTCACTTCCAGGCCTGGGCGTG
TGCATCCTCCACTCTCTTCCCCTGTGGGTGCAGAAGGCGCGGCACAGGGCCCTGAAACCTTGGAGGTCGGTGGAGCCCA
AAATGAAGGCAGCGTGGGCCTCTGGGTCTTCATGTAAATTTAGGTAACACTGAACTGTCAGGTGAACAAGAAATAAACGT
CAAATGTATTCAGTCGATTAGATTTGGTGATGGTTGTTACAGCGGTTACCCTCCCTCAACATAATAAATTTTCAAACAA
CTCATAATGGCTCACTCATGTATAAAATATTCCATATGAAATCCCGGGATAACATGCTTATTCTAGCTCAAGCTTAATC
AGAGTAGTCCATCTGAGGGAGGAGATAGTAGAGGGCCAGCAAGGGGTTGTCACTGAAGATAACTAGCCTTGCTAAAAGAA
TGGTTGAAGAAGTGAGCTACAGATAGGGTAAATCCACATCTCAGACATTCTGTGATGGTCCTGATATTATCCTAAAGTA
AAATGTAGAGTTGAACCATTTTAATTAGATTCTAGAATTCTATTAATTTATAAGATGGGCATTTCCACAAAGGACTAAA
CAAAGTACAAGAGGATTAAATAATCATCCACATGGGAGGCACCGCCTTGCACTTTAAAATGATGGAGCTTATCAAGACT
GGCTGTGGATATCTGTCCCTGGGAGGGTTTTTTCCCCCATTTTTTTCCTTTTTGAGACATGTTCTCGCTATGTTGCCCA
GGCTGGTCTTGAACTCCTGGGCTCAAGTGATCCT

SEQ ID:12
>STAR12
ATCCTGCTTCTGGGAAGAGAGTGGCCTCCCTTGTGCAGGTGACTTTGGCAGGACCAGCAGAAACCCAGGTTTCCTGTCA
GGAGGAAGTGCTCAGCTTATCTCTGTGAAGGGTCGTGATAAGGCACGAGGAGGCAGGGGCTTGCCAGGATGTTGCCTTT
CTGTGCCATATGGGACATCTCAGCTTACGTTGTTAAGAAATATTTGGCAAGAAGATGCACACAGAATTTCTGTAACGAA

FIG. 26 (CONT)

TAGGATGGACTTTTAAGGGTTACTACGAAAAAAAGAAAACTACTGGAGAAGAGGGAAGCCAAACACCACCAAGTTTGAA
ATCGATTTTATTGGACGAATGTCTCACTTTAAATTTAAATGGAGTCCAACTTCCTTTTCTCACCCAGACGTCGAGAAGC
TGGCATTCAAAATGTTTACACTTGTTTCATCTGCCTTTTTGCTAAGTCCTGGTCCCCTACCTCCTTTCCCTCACTTCAC
ATTTGTCGTTTCATCGCACACATATGCTCATCTTTATATTTACATATATATAATTTTTATATATGGCTTGTGAAATATG
CCAGACGAGGGATGAAATAGTCCTGAAAACAGCTGGAAAATTATGCAACAGTGGGGAGATTGGGCACATGTACATTCTG
TACTGCAAAGTTGCACAACAGACCAAGTTTGTTATAAGTGAGGCTGGGTGGTTTTATTTTTTCTAGGACAACAGCT
TGCCTGGTGGAGTAGGCCTCCTGCAGAAGGCATTTTCTTAGGAGCCTCAACTTCCCCAAGAAGAGGAGAGGGCGAGACT
GGAGTTGTGCTGGCAGCACAGAGACAAGGGGGCACGGCAGGACTGCAGCCTGCAGAGGGGCTGGAGAAGCGGAGGCTGG
CACCCAGTGGCCAGCGAGGCCCAGGTCCAAGTCCAGCGAGGTCGAGGTCTAGAGTACAGCAAGGCCAAGGTCCAAGGTC
AGTGAGTCTAAGGTCCATGCTCAGTGAGGTCGAGACCCAGGGTCCAATGAGGCCAAGGTCCAGAGTCCAGTAAGGCCGA
GATCCAGGGTCCAGGGAGGTCAAG

SEQ ID:13
>STAR13
CTGCCCTGATCCCTTAATGCTTTTGGCCCAGAGCACCCCGCTAAGTCCAACCCCAGAGGGGCCTCATCCGCAAAGCCTC
GGGAAGAGGACAGTGACGGAGGCGGCTGCCCTGTGAGCTGCACGGGGCAGAATGTCCTTTTGGCGTCATGTTGGATGTC
CACACATCCATATGGGGTCAGTTCTATTAGGATTCCTTCGGGAAGAGGTAGAGGGTAGGAGGGGTTAAGCCACGAGACG
AGGCATGCAGAGGGGTGGCCTGGATGGCTCTGCACTGCTGTCCATGCACACGGGGAGCGTTGCAAATTGTGCTTCCCAG
CCCATAGTGCCCCCACAGAGGAGCCCGGGAGTCCCTGGTGGGCGTCTGTGTTCCTGCAAGGAGCCAGTGGAGATGGCCC
CGTGAACTCTCATCCCCCTTGCCTTGGTGGGGTCTCTGGCAGGTTTATGGAGCCGTACATCTTTGGGAGCCGCCTGGAC
CACGACATCATCGACCTGGAACAGACAGCCACGCACCTCCAGCTGGCCTTGAACTTCACCGCCCACATGGCCTACCGCA
AGGGCATCATCTTGTTTATAAGCCGCAACCGGCAGTTCTCGTACCTGATTGAGAACATGGCCCGTGACTGTGGCGAGTA
CGCCCACACTCGCTACTTCAGGGGCGGCATGCTGACCAACGCGCGCCTCCTCTTTGGCCCCACGGTCCGCCTGCCGGAC
CTCATCATCTTCCTGCACACGCTCAACAACATCTTTGAGCCACACGTGGCCGTGAGAGACGCAGCCAAGATGAACATCC
CCACAGTGGGCATCGTGGACACCAACTGCAACCCCTGCCTCATCACCTACCCTGTACCCGGCAATGACGACTCTCCGCT
GGCTGTGCACCTCTACTGCAGGCTCTTCCAGACGGCCATCACCCGGGCCAAGGAGAAGCGGCAGCAGGTTGAGGCTCTC
TATCGCCTGCAGGGCCAGAAGGAGCCCGGGGACCAGGGGCCAGCCCACCCTCCTGGGGCTGACATGAGCCATTCCCTGT
GATGTTCACTCTCCTCCCAAAGCAAACCACAGCCAAGCCTGTCTGAGCTGGGAGTCCCCTTCCCCAGCCCTGGGTCAGC
GGCATCCTCAGTCGTTGTTACTTACTCAGCTGATGTCACAGTGCAGACATCCACCGTTCCACCACAGAACCAGTGGCTG
AGCGGACCAACGTTGCCATGTGCGTTTGCTCTGTGGGGAACAGAGCACAGAGGGTGAGCGACATGTGCAGAACGGCCCC
TTGGCTGCAGTTAGGACCTCAGTGGCT

SEQ ID:14
>STAR14
AGCAAGGACCAGGGCTCTGCCTCCCCAGTCAGCATGAGCAGAGCAGACTCCTTTGAGCAGAGCATCAGGGCAGAAATAG
AACAGTTTCTGAATGAGAAAAAGACAGCATCAGACCCAAAAATGTGATGGGTCAGTGGAGAAGAAACCAGACACACATGA
AAATTCGGCGAAGTCACTCTCGAAATCCCACCAAGAGCCGGCTACAAAGGTGGTGCACCGGCAGGGCCTGATGGGCGTC
CAGAAGGAGTTCGCCTTCTGCAGACCTCCCCCGGTTAGCAAAGACAAACGTGCAGCCCAGAAGCCTCAGGTCCAAGGTC
ACGACCACGACCACGCAGGAGAAGGAGGGCAGCACAAAGCCAGCAACCCCCACCGCCCTTCAGAAGCACTACAGAATAA
AAGTGGGATTAAAAGGAACGCCAGCACCGCAAGGAGGGGAAAGCGAGTCACGAGCGCCGTACAGGCGCCCGAGGCGTCC
GACTCCAGCAGCGACGACGGCATTGAGGAGGCCATCCAGCTGTACCAGGTGCAGAAAACACACAAGGAGGCCGACGGGG
ACCCGCCCCAGAGGGTCCAGCTCCAAGAGGAAAGAGCACCTGCCCCTCCCGCACACAGCACAAGCAGCGCCACAAAAAG
TGCCTTGCCAGAGACCCACAGGAAAACACCCAGCAAGAAGAAGCCAGTGCCCACCAAGACCACGGACCCTGGTCCAGGG

SEQ ID:15
>STAR15
CAGTACATGCAGAACTGAGTCCAAACGAGACGGACAGCAAACCCGGCAGTGGGCTCCCAGACATTCCTGGGGGAAAGGG
ATCCTAACCACAGGCAGTTAAAGTCATCTCCTCCAACCCTCTATGACACAGGCTGTGCGCTGTCATTTAAAAGCTGAGT
GAAATTTAACCCTTTTCCCATTTAGAAAAACAAAGCGCAGCTGGCTGCCAGCACTCATTTAATTTTACATAAACGTGCT
CTTTGAGGCTGAAGCAAATCTGACTGATTTTCAATGTGAAAATAAAATGTAAAAACTGTTCTTGGAATTATTTCTAAAC
AGAACATCAGAATCGTCTGAATCATCAGAATCGGCTATTTTGGAAAAATCGGATTCATCAAACGAATCTTCGGCCAACA
ACTGTTAGAGAACGATGTTAACACCACGCATAGGAATGTTACATTTTCTAGAATTTGACATTTTCATTGACGGAAAATT
ACTGTATCTTGTATATGGAAATACCACTACTAAAAACATAATGCTATAAATAGAATGATGTCTTTTGTTTCCAAAGTCA
ATATACTCGAGCAATGCAAAAATAATAATAAAAGTGAGATACTTCATGGCAAAGCTGCCGCAGGATAAACATTGCAGCC
ACAAGTGCCCCCAGTATTCTCGGGGCAAACTGGAAAAGGGCTAACAGGCAACATTTTCATGTTATTCTACTGAGTGCAG
TAATTATTTTTAAAAATATACATGAATAATGAAAAAACTGTGCTATGGTTTTAAAGAAATTTCCATAACCTGGTGAAAC
TCTTCACACACGCTAATAGGTTCATAAAGCCTTGGTCCTCTGCAAAACAAGCATCAACTTGACAATGACTAAAAGAAGC
AACAGCAAAACTGTCACGCATTTGGAGCCATGGCCTGGGTTGGGCCGGTGTAAAGCTCTCCCCCCTCTGGAGCAAGTCT
GGGCCCCAGCGGCTGGCATGTGGGCACTGCAGGGCCTGGGTTGGGCAGGTGTGCAGCTCTCCGTCATCTGAGCCTAGTC
TGAGGCCTGGTGGCTGGCACGTGGGCCCTGCAGGGCCTCTACTTCTCACCCCAGCTCCACTTCCCTCCCTGCCCTCACT
GGGTCTCACAGAGCCAATGAACACTGGGTCAGATTCAGGGCCCAGCATCCACTGCAGTGGGCACTGCCCTTCCACAAG
GCCTGGCTCCAGGAAGCAACCCCCACCTCAGCCACACAGTAGGGCAACAGGAAATCCCATTCCCCCATGCCAGTGACTA
CACCAGGGAAGGGGCTCACGTGAGGCTGGCCCCAGGCCTGCTCTGAGACCGCGTTGTCTATGAGCTTGGATTTAAGGAA

FIG. 26 (CONT)

CTTGGGAGCAAGAAGCTTTCTTTCATTACGGGCCACCAGCAGGGAAAAAAGTTAGCCCAACGCAGTTGACAGTCACACC
CCCACCAGGACCCCAGGGCACAGAAGGAGGGAAGAGGACAACAGAGGATGAGGTGGGGCCAGCAGAGGGACAGAGAAGA
GCTGCCTGCCCTGGAACAGGCAGAAAGCATCCCACGTGCAAGAAAAAGTAGGCCAGCTAGACTTAAAATCAGAACTACC
GCTCATCAAAAGATAGTGTAACATTTGGGGTGCTATAATTTTAACATGTCCCCCAAAAGGCATGTGTTGGAAATTTAAT
CCCCAACAAACCAGGGCTGGGAGGTGGAGCCTCATGAGAGGTGGTGAGGCCATGAGGGTGGAGTGAATGGATGAATGCC
ATTGTCTCGGGAATGGGCCTCTTCTACAAGGACGAGTTCAGCCCCCCTTTCTCTTGCTCACCCTCTCTTTGCCCTTTCG
CTAGGGAGTGACGTAACAAGAAGGCCCTCACAAGATGCTGGCACCTTGATCTTGGACTC

SEQ ID:16
>STAR16
CGCCCACCTCGGCTTTCCAAAGTGCTGGGATTACAGGCATGAGTCACTGCGCCCATCCTGATTCCAAGTCTTTACATAA
TAACTTAACTTTTTCGACCAATTGCCAATCAGGCAATCTTTGAATCTGCCTATGACCTAGGACATCCCTCTCCCTACAA
GTTGCCCCGCGTTTCCAGACCAAACCAATGTACATCTTACATGTATTGATTGAAGTTTTACATCTCCCTAAAACATATA
AAACCAAGCTATAGTCTGACCACCTCAGGCACGTGTTCTCAGGACCTCCCTGGGGCTATGGCATGGGTCCTGGTCCTCA
GATTTGGCTCAGAATAAATCTCTTCAAATATTTTCCAGAATTTTACTCTTTTCATCACCATTACCTATCACCCATAAGT
CAGAGTTTTCCACAACCCCTTCCTCAGATTCAGTAATTTGCTAGAATGGCCACCAAACTCAGGAAAGTATTTTACTTAC
AATTACCAATTTATTATGAAGAACTCAAATCAGGAATAGCCAAATGGAAGAGGCATAGGGAAAGGTATGGAGGAAGGGG
CACAAAGCTTCCATGCCCTGTGTGCACACCACCCTCTCAGCATCTTCATGTGTTCACCAACTCAGAAGCTCTTCAAACT
TTGTCATTTAGGGGTTTTTATGGCAGTTCCACTATGTAGGCATGGTTGATAAATCACTGGTCATCGGTGATAGAACTCT
GTCTCCAGCTCCTCTCTCTCTCCTCCCCAGAAGTCCTGAGGTGGGGCTGAAAGTTTCACAAGGTTAGTTGCTCTGACAA
CCAGCCCCTATCCTGAAGCTATTGAGGGGTCCCCCAAAAGTTACCTTAGTATGTTGGAAGAGGCTTATTATGAATAAC
AAAAGATGCTCCTATTTTTACCACTAGGGAGCATATCCAAGTCTTGCGGGAACAAAGCATGTTACTGGTAGCAAATTCA
TACAGGTAGATAGCAATCTCAATTCTTGCCTTCTCAGAAGAAAGAATTTGACCAAGGGGGCATAAGGCAGAGTGAGGGA
CCAAGATAAGTTTTAGAGCAGGAGTGAAAGTTTATTAAAAAGTTTTAGGCAGGAATGAAAGAAAGTAAAGTACATTTGG
AAGAGGGCCAAGTGGGCGACATGAGAGAGTCAAACACCATGCCCTGTTTGATGTTTGGCTTGGGGTCTTATATGATGAC
ATGCTTCTGAGGGTTGCATCCTTCTCCCCTGATTCTTCCCTTGGGGTGGGCTGTCCGCATGCACAATGGCCTGCCAGCA
GTAGGGAGGGGCCGCATG

SEQ ID:17
>STAR17
ATCCGAGGGGAGGAGGAGAAGAGGAAGGCGAGCAGGGCGCCGGAGCCCGAGGTGTCTGCGAGAACTGTTTTAAATGGTT
GGCTTGAAAATGTCACTAGTGCTAAGTGGCTTTTCGGATTGTCTTATTTATTACTTTGTCAGGTTTCCTTAAGGAGAGG
GTGTGTTGGGGGTGGGGGAGGAGGTGGACTGGGGAAACCTCTGCGTTTCTCCTCCTCGGCTGCACAGGGTGAGTAGGAA
ACGCCTCGCTGCCACTTAACAATCCCTCTATTAGTAAATCTACGCGGAGACTCTATGGGAAGCCGAGAACCAGTGTCTT
CTTCCAGGGCAGAAGTCACCTGTTGGGAACGGCCCCCGGGTCCCCTGCTGGGCTTTCCGGCTCTTCTAGGCGGCCTGA
TTTCTCCTCAGCCCTCCACCCAGCGTCCCTCAGGGACTTTTCACACCTCCCCACCCCCATTTCCACTACAGTCTCCCAG
GGCACAGCACTTCATTGACAGCCACACGAGCCTTCTCGTTCTCTTCTCCTCTGTTCCTTCTCTTTCTCTTCTCCTCTGT
TCCTTCTCTTTCTCTGTCATAATTTCCTTGGTGCTTTCGCCACCTTAAACAAAAAAGAGAAAAAAATAAAATAAAAAAA
ACCCATTCTGAGCCAAAGTATTTTAAGATGAATCCAAGAAAGCGACCCACATAGCCCTCCCCACCCACGGAGTGCGCCA
AGACGCACCCAGGCTCCATCACAGGGCCGAGAGCAGCGCCACTCTGGTCGTACTTTTGGGTCAAGAGATCTTGCAAAAG
AGG

SEQ ID:18
>STAR18
ATCTTTTTGCTCTCTAAATGTATTGATGGGTTGTGTTTTTTTCCCACCTGCTAATAAATATTACATTGCAACATTCTT
CCCTCAACTTCAAAACTGCTGAACTGAAACAATATGCATAAAAGAAAATCCTTTGCAGAAGAAAAAAAGCTATTTTCTC
CCACTGATTTTGAATGGCACTTGCGGATGCAGTTCGCAAATCCTATTGCCTATTCCCTCATGAACATTGTGAAATGAAA
CCTTTGGACAGTCTGCCGCATTGCGCATGAGACTGCCTGCGCAAGGCAAGGGTATGGTTCCCAAAGCACCCAGTGGTAA
ATCCTAACTTATTATTCCCTTAAAATTCCAATGTAACAACGTGGGCCATAAAAGAGTTTCTGAACAAAACATGTCATCT
TTGTGGAAAGGTGTTTTTCGTAATTAATGATGGAATCATGCTCATTTCAAAATGGAGGTCCACGATTTGTGGCCAGCTG
ATGCCTGCAAATTATCCT

SEQ ID:19
>STAR19
TCACTTCCTGATATTTTACATTCAAGGCTAGCTTTATGCATATGCAACCTGTGCAGTTGCACAGGGCTTTGTGTTCAGA
AAGACTAGCTCTTGGTTTAATACTCTGTTGTTGCCATCTTGAGATTCATTATAATATAATTTTTGAATTTGTGTTTTGA
ACGTGATGTCCAATGGGACAATGGAACATTCACATAACAGAGGAGACAGGTCAGGTGGCAGCCTCAATTCCTTGCCACC
CTTTTCACATACAGCATTGGCATGCCCCATGAGCACAAAATTTGGGGAACCATGATGCTAAGACTCAAAGCACATAT
AAACATGTTACCTCTGTGACTAAAAGAAGTGGAGGTGCTGACAGCCCCCAGAGGCCACAGTTTATGTTCAAACCAAAAC
TTGCTTAGGGTGCAGAAAGAAGGCAATGGCAGGGTCTAAGAAACAGCCCATCATATCCTTGTTTATTCATGTTACGTCC
CTGCATGAACTAATCACTTACACTGAAAATATTGACAGAGGAGGAAATGGAAAGATAGGGCAACCCATAGTTCTTTTTC
CTTTTAGTCTTTCCTTATCAGTAAACCAAAGATAGTATTGGTAAAATGTGTGAGTTAATTAATGAGTTAGTTTTAGG
CAGTGTTTCCACTGTTGGGGTAAGAACAAAATATATAGGCTTGTATTGAGCTATTAAATGTAAATTGTGGAATGTCAGT

FIG. 26 (CONT)

```
GATTCCAAGTATGAATTAAATATCCTTGTATTTGCATTTAAAATTGGCACTGAACAACAAAGATTAACAGTAAAATTAA
TAATGTAAAAGTTTAATTTTTACTTAGAATGACATTAAATAGCAAATAAAAGCACCATGATAAATCAAGAGAGAGACTG
TGGAAAGAAGGAAAACGTTTTTATTTTAGTATATTTAATGGGACTTTCTTCCTGATGTTTTGTTTTGTTTGAGAGAGA
GGGATGTGGGGGCAGGGAGGTCTCATTTTGTTGCCCAGGCTGGACTTGAACTCCTGGGCTCCAGCTATCCTGCCTTAGC
TTCTTGAGTAGCTGGGACTACAGGCACACACCACAGTGTCTGACATTTTCTGGATTTTTTTTTTTTTTTATTTTTTTT
GTCAGACAGGTTCTGGCTCTGTTACTCAGGTTGCAGTGCAGTGGCATGATAGCGGCTCACTGCAGCCTCAACCTCCTCA
GCTTAAGCTACTCTCCCACTTCAGCCTCCTGAGTAGCCAGGACTACAGTTGTGTGCCACCACACCTGTGGCTAATTTTT
GTAGAGATGGGGTCTCTCCACGTTGCCGAGGCTGGTCTCCAACTCCTGGTCTCAAGCGAACCTCCTGACTTGGCCTCCC
GAAGTGCTGGGATTACAGGCTTGAGCCACTGCATCCAGCCTGTCCTCTGTGTTAAACCTACTCCAATTTGTCTTTCATC
TCTACATAAACGGCTCTTTTCAAAGTTCCCATAGACCTCACTGTTGCTAATCTAATAATAAATTATCTGCCTTTTCTTA
CATGGTTCATCAGTAGCAGCATTAGATTGGGCTGCTCAATTCTTCTTGGTATATTTTCTTCATTTGGCTTCTGGGCAT
CACACTCTCTTTGAGTTACTCATTCCTCATTGATAGCTTCTTCCTAGTCTTCTTTACTGGTTCTTCCTCTTCTCCCTGA
CTCCTTAATATTGTTTTTCTCCCCAGGCTTTAGTTCTTAGTCCTCTTCTGTTATCTATTTACACCCAATTCTTTCAGAG
TCTCATCCAGAGTCATGAACTTAAACCTGTTTCTGTGCAGATAATTCACATTATTATATCTCCAGCCCAGACTCTCCCG
CAAACTGCAGACTGATCCTACTG

SEQ ID:20
>STAR20
GATCTCAAGTTTCAATATCATGTTTTGGCAAAACATTCGATGCTCCCACATCCTTACCTAAAGCTACCAGAAAGGCTTT
GGGAACTGTCAACAGAGCTACAGAAAAGTCAGTAAAGACCAATGGACCCCTCAAACAAAAACAGCCAAGCTTTTCTGCC
AAAAAGATGACTGAGAAGACTGTTAAAGCAAAAAACTCTGTTCCTGCCTCAGATGATGGCTATCCAGAAATAGAAAAT
TATTTCCCTTCAATCCTCTAGGCTTCGAGAGTTTTGACCTGCCTGAAGAGCACCAGATTGCACATCTCCCCTTGAGTGA
AGTGCCTCTCATGATACTTGATGAGGAGAGAGAGCCTTGAAAAGCTGTTTCAGCTGGGCCCCCCTTCACCTTTGAAGATG
CCCTCTCCACCATGGAAATCCAATCTGTTGCAGTCTCCTTTAAGCATTCTGTTGACCCTGGATGTTGAATTGCCACCTG
TTTGCTCTGACATAGATATTTAAATTTCTTAGTGCTTTAGAGTTTGTGTATATTTCTATTAATAAAGCATTATTTGTTT
AACAGAAAAAAGATATATACTTAAATCCTAAAATAAAATAACCATTAAAAGGAAAAACAGGAGTTATAACTAATAAGG
GAACAAAGGACATAAAATGGGATAATAATGCTTAATCCAAAATAAAGCAGAAAATCAAGAAAAATGAAATGAAGAACAG
ATAAATAGAAAACAAATAGCAATATGAAAGACAAACTTGACCGGGTGTGGTGGCTGATGCCTGTAATCC

SEQ ID:21
>STAR21
GATCAATAATTTGTAATAGTCAGTGAATACAAAGGGGTATATACTAAATGCTACAGAAATTCCATTCCTGGGTATAAAT
CCTAGACATATTTATGCATATGTACACCAAGATATATCTGCAAGAATGTTCACAGCAAATCTCTTTGTAGTAGCAAAAG
GCCAAAAGGTCTATCAACAAGAAAATTAATACATTGTGGCACATAATGGCATCCTTATGCCAATAAAAATGGATGAAAT
TATAGTTAGGTTCAAAAGGCAAGCCTCCAGATAATTTATATCATATAATTCCATGTACAACATTCAACAACAAGCAAAA
CTAAACATATACAAATGTCAGGGAAAATGATGAACAAGGTTAGAAAATGATTAATATAAAAATACTGCACAGTGATAAC
ATTTAATGAGAAAAAAGAAGGAAGGGCTTAGGGAGGGACCTACAGGGAACTCCAAAGTTCATGGTAAGTACTAAATAC
ATAATCAAAGCACTCAAAATAGAAAATATTTTAGTAATGTTTTAGCTAGTTAATATCTTACTTAAAACAAGGTCTAGGC
CAGGCACGGTGGCTCACACCTGTAATCCCAGCACTTTGGGAGGCTGAGGCGGGT

SEQ ID:22
>STAR22
CCCTTGTGATCCACCCGCCTTGGCCTCCCAAAGTGCTGGGATTACAGGCGTGAGTCACTACGCCCGGCCACCCTCCCTG
TATATTATTTCTAAGTATACTATTATGTTAAAAAAGTTTAAAAATATTGATTTAATGAATTCCCAGAAACTAGGATTT
TACATGTCACGTTTTCTTATTATAAAAATAAAAATCAACAATAAATATATGGTAAAAGTAAAAAGAAAAACAAAAACAA
AAAGTGAAAAAAATAAACAACACTCCTGTCAAAAAACAACAGTTGTGATAAAACTTAAGTGCCTGAAAATTTAGAAACA
TCCTTCTAAAGAAGTTCTGAATAAAATAAGGAATAAAATAATCACATAGTTTTGGTCATTGGTTCTGTTTATGTGATGG
ATTATGTTTATTGATTTGTGTATGTTGAACTTATCTCAATAGATGCAGACAAGGCCTTGATAAAAGTTTTTAACACCTT
TTCATGTTGAAAACTCTCAATAGACTAGGTATTGATGAAACATATCTCAAAATAATAGAAGCTATTTATGATAAACCCA
TAGCCAATATCATACTGAGTGGGCAAAAGCTGGAAGCATTCCCTTTGAAAACTGGCACAAGACAAGGATGCCCTCTCTC
ACCACTCCTATTAAATGTAGTATTGGAAGTTCTGGCCAGAGCAATCAGGCAGGAGAAAGAAAAGGTATTAAAATAGGAA
GAGAGGAAGTCAAATTGTCTCTGTTTGCAGTAAACATGATTGTATATTTAGAAAACCCCATTGTCTCATCCTAAAAACT
CCTTAAGCTGATAAACAACTTCAGCAAAGTCTCAGGATACAAAATCAATGTGCAAAAATCACAAGCATTCCTATACACC
GATAATAGACAGCAGAGAGCCAAATCATGAGTGAAGTCCCATTCACAATTGCTTCAAAGAAAATAAAATACTTAGGAAT
ACAACTTTCACGGGACATGAAGGACATTTTCAAGGACAACTAAAAACCACTGCTCAAGGAAATGAGAGAGGACACAAAG
AAATGGAAAAACATTCCATGCTCATGGAAGAATCAATATGAAAATGGCCATACTGCCCAAAGTAATTTATAGATTC
AATGCTAACCCCATCAAGCCACCATTGACTTTCTTCACAGAACTAGAAAAAAACTATTTTAAAACTCATATGTAGTCAA
AAAGAGTCGGTATAGCCAAGACAATCCTAAGCATAAAGAACAAAGCTGGATGCATCACGCTGACTTCAAACCATACTAC
AAGGCTACAGTAACCAAAACAGCATGGTACTGGTACCAAAACAGATAGATAGACCGATAGAACAGAACAGAGGCCTCGG
AAATAACACCACACATCTACAACCCTTTGATCTTCAA

SEQ ID:23
>STAR23
```

FIG. 26 (CONT)

ATCCCCTCATCCTTCAGGGCAGCTGAGCAGGGCCTCGAGCAGCTGGGGGAGCCTCACTTAATGCTCCTGGGAGGGCAGC
CAGGCAGCATGGGTCTGCAGGCATGGTCCAGGGTCCTGCAGGCGGCACGCACCATGTGCAGCCGCCCCCACCTGTTGC
TCTGCCTCCGCCACCTGGCCATGGGCTTCAGCAGCCAGCCACAAAGTCTGCAGCTGCTGTACATGGACAAGAAGCCCAC
AAGCAGCTAGAGGACCTTGTGTTCCACGTGCCCAGGGAGCATGGCCCACAGCCCAAAGACCAGTCAGGAGCAGGCAGGG
GCTTCTGGCAGGCCCAGCTCTACCTCTGTCTTCACACAGATGGGAGATTTCTGTTGTGATTTTGAGTGATGTGCCCCTT
TGGTGACATCCAAGATAGTTGCTGAAGCACCGCTCTAACAATGTGTGTGTATTCTGAAAACGAGAACTTCTTTATTCTG
AAATAATTGATGCAAAATAAATTAGTTTGGATTTGAAATTCTATTCATGTAGGCATGCACACAAAAGTCCAACATTGCA
TATGACACAAAGAAAAGAAAAAGCTTGCATTCCTTAAATACAAATATCTGTTAACTATATTTGCAAATATATTTGAATA
CACTTCTATTATGTTACATATAATATTATATGTATATGTATATATAATATACATATATATGTTACATATAATATACTTC
TATTATGTTACATATAATATTTATCTATAAGTAAATACATAAATATAAAGATTTGAGTAGCTGTAGAACATTGTCTTAT
GTGTTATCAGCTACTACTACAAAAATATCTCTTCCACTTATGCCAGTTTGCCATATAAATATGATCTTCTCATTGATGG
CCCAGGGCAAGAGTGCAGTGGGTACTTATTCTCTGTGAGGAGGGAGGAGAAAAGGGAACAAGGAGAAAGTCACAAAGGG
AAAACTCTGGTGTTGCCAAAATGTCAAGTTTCACATATTCCGAGACGGAAAATGACATGTCCCACAGAAGGACCCTGCC
CAGCTAATGTGTCACAGATATCTCAGGAAGCTTAAATGATTTTTTTAAAAGAAAAGAGATGGCATTGTCACTTGTTTCT
TGTAGCTGAGGCTGTGGGATGATGCAGATTTCTGGAAGGCAAAGAGCTCCTGCTTTTTCCACACCGAGGGACTTTCAGG
AATGAGGCCAGGGTGCTGAGCACTACACCAGGAAATCCCTGGAGAGTGTTTTCTTACTTA

SEQ ID:24
>STAR24
ACGAGGTCACGAGTTCGAGACCAGCCTGGCCAAGATGGTGAAGCCCTGTCTCTACTAAAAATACAACAAGTAGCCGGGC
GCGGTGACGGGCGCCTGTAATCCCAGCTACTCAGGAGGCTGAAGCAGGAGAATCTCTAGAACCCAGGAGGCGGAGGTGC
AGTGAGCTGAGACTGCCCCGCTGCACTCTAGCCTGGGCAACACAGCAAGACTCTGTCTCAAATAAATAAATAAATAAAT
AAATAAATAAATAAATAAATAGAAAGGGAGAGTTGGAAGTAGATGAAAGAGAAGAAAAGAAATCCTAGATTTCCT
ATCTGAAGGCACCATGAAGATGAAGGCCACCTCTTCTGGGCCAGGTCCTCCCGTTGCAGGTGAACCGAGTTCTGGCCTC
CATTGGAGACCAAAGGAGATGACTTTGGCCTGGCTCCTAGTGAGGAAGCCATGCCTAGTCCTGTTCTGTTTGGGCTTGA
TCCTGTATCACTTGATTGTCTCTCCTGGACTTTCCATGGATTCCAGGGATGCAACTGAGAAGTTTATTTTTAATGCACT
TACTTGAAGTAAGAGTTATTTTAAAACATTTTAGCAAAGGAAATGAATTCTGACAGGTTTTGCACTGAAGACATTCACA
TGTGAGGAAAACAGGAAAACCACTATGCTAGAAAAAGCAAATGCTGTTGAGATTGTCTCACAAACACAAATTGCGTGCC
AGCAGGTAGGTTTGAGCCTCAGGTTGGGCACATTTTACCTTAAGCGCACTGTTGGTGGAACTTAAGGTGACTGTAGGAC
TTATATATACATACATACATATAATATATATACATATTTATGTGTATATACACACACACACACACACACACACAGGG
TCTTGCTATCTTGCCCAGGGTGGTCTCCAACTCTGGGTCTCAAGCGATCCTCTGCCTCCCCTTCCCAAAG

SEQ ID:25
>STAR25
ATAAAAAAATAAAAAACCCTGCTCTAATTTGCAAAGGCTCTATCTTTCCTCCCAACCACCTGAAATTTTAGTGAAAACG
GGGCTTCCTGTAGGAAGGAGTAGCTAGCTATCCCGGTCCGCTACAGGTTATCAGTGCGTGAATACCCTGACTCCTAAGG
CTCAGGATTTGACTGGGTCGCCTCCGACTGCCCCGCCCCCAACGCGGACCCACGTCACCGCGCGCCAGCCTGCGG
CGTCCTGACCTCGCGGGATTTGAGCTTCGGTGCCAACAAACACTCCCACCGCGCTGCGTCCACTTTACCTGCCGGCGG
CGACCAGCTTCTGAAGAAAAGTGTCCACCATGGTGTCGAGGAGCTTCACCCTCGAAATGGTAGTGCCGGGTGGCACAGA
TTCCGAAGACGACCCCTCATGCCTTTTTTCCTCACAGCCGCTGCCTAGATTGGCGCTACTTGCTTCGGCCATGTTGAAG
TTGAACCTCCAAATCTAACTGGCCCGGCCTCCCCGCCTGCCGGAGCTCCCGATTGGCCGCTCCCGCGAAGGGTGCCTCC
GATTGGAAGCAGTAGAACGTCTGTCACCGAGCAGGGCGGGGGCGGGGAAGTCATCGGAGGCTGAGGGCAGCGGGGAGGC
GAGGCTCTGCGCGGTGGGATGTCCGCGACCGGAAAAATACGCGCAAGCCAAAGCTCGGGGGCTCAATAAAAACTTTTAA
TTACATTTCAGAGACTTCGTACAGTGCAACAGTGAATATTCACTGTTAATTTTCACAAGAGTCCATTTCATCAAACGTT
CAGAGAGTCTGCCTTTTCATTCCCTTGTTCCTCAGTGCTCCAATCAGGTTTCCAGTCTCCCAGAGGTTTCTTTTAGTTT
TGATTACCGACCAAAACTCCAGTTTAGGGAGAATGGAAGTCCACCGTCCCATCCCCACCAAAACATATTTCAGTCAAAC
CCAATCCCAGTCCCTAAAGAATTAGGAAAGTATGGGCCAAGGGTCCTTTTAATTATACACACATCACCCTTAAAACTGC
GTGTGTGTACGAGAAATAAAGAAAAACACAAGAGGGGCTG

SEQ ID:26
>STAR26
CCCCCTGACAAGCCCCAGTGTGTGATCTTCCCCACTCTGTGTCCATGCATTCTCATTGTTCAACTCCCATCTGTGAGTG
AGAACATGCAGTGTTTGGTTTTCTGTCCTTGAGATAGTTTGCTGAGAATGATGGTTTCCAGCTTCATCCATGTCCTTGC
AAAGGAACTGAACTTATCCTTTTTTATGGCTTCATAGTATTCCATGGCACATATGTGCCACATTTTTTTAATCCAGTCT
ATCATTGATGGACATTTGGGTTGGTTCCAAGTCTTTGCTATTGTGAATAGCACCACAATTAACATATGTGTGCATGTAT
ACATCTTTATAGTAGCATGATTTATAATCCTTCGGGTATATACCCTGTAATGGGATCGCTGGGTCAAATGGTATTTCTA
GTTCTAGATCCTTGAGGAATCACCACACTGCTTTCCACAATGGTTGAACTAATTTACGCTCCCACCAGCAGTGTAAAAG
CATTCCTATTTCTCCACGTCCTCTCCAGTATCTGTTGTTTCCTGACTTTTTAATGATCATCATTCT

SEQ ID:27
>STAR27
CTTGGCCCTCACAAAGCCTGTGGCCAGGGAACAATTAGCGAGCTGCTTATTTTGCTTTGTATCCCCAATGCTGGGCATA
ATGCCTGCCATTATGAGTAATGCCGGTAGAAGTATGTGTTCAAGGACCAAAGTTGATAAATACCAAAGAATCCAGAGAA

FIG. 26 (CONT)

```
GGGAGAGAACATTGAGTAGAGGATAGTGACAGAAGAGATGGGAACTTCTGACAAGAGTTGTGAAGATGTACTAGGCAGG
GGGAACAGCTTAAGGAGAGTCACACAGGACCGAGCTCTTGTCAAGCCGGCTGCCATGGAGGCTGGGTGGGGCCATGGTA
GCTTTCCCTTCCTTCTCAGGTTCAGAGTGTCAGCCTTGAACTTCTAATTCCCAGAGGCATTTATTCAATGTTTTCTTCT
AGGGGCATACCTGCCCTGCTGTGGAAGACTTTCTTCCCTGTGGGTCGCCCCAGTCCCCAGATGAGACGGTTTGGGTCAG
GGCCAGGTGCACCGTTGGGTGTGTGCTTATGTCTGATGACAGTTAGTTACTCAGTCATTAGTCATTGAGGGAGGTGTGG
TAAAGATGGAGATGCTGGGTCACATCCCTAGAGAGGTGTTCCAGTATGGGCACATGGGAGGCTGGAAGGATAGGTTAC
TGCTAGACGTAGAGAAGCCACATCCTTTAACACCCTGGCTTTTCCCACTGCCAAGATCCAGAAAGTCCTTGTGGTTTCG
CTGCTTTCTCCTTTTTTTTTTTTTTTTTTTCTGAGATGGAGTCTGGCTCTGTCGCCCAGGCTGGAGTGCAGTGGCAC
GATTTCGGCTCACTGCAAGTTCCGCCTCCTAGGTTCATACCATTCTCCCACCTCAGCCTCCCGAGTAGCTGGGACTACA
GGCGCCACCACACCCAGCTAATTTTTTGTATTTTTAGTAGAGACGGCGTTTCACCATGTTAGCCAGGATGGTCTTGATC
CGCCTGCCTCAGCCTCCCAAAGTGCTGGGATTACAGGCGTGAGCCACCGCGCCCGGCCTGCTTCTTCTTTCATGAAGC
ATTCAGCTGGTGAAAAAGCTCAGCCAGGCTGGTCTGGAACTCTTGACCTCAAGTGATCTGCCTGCCTCAGCCTCCCAAA
GTGCTGAGATTACAGGCATGAGCCAGTCCGAATGTGGCTTTTTTTGTTTTGTTTTGAAACAAGGTCTCACTGTTGCCCA
GGCTGCAGTGCAGTGGCATACCTCAGCTCCACTGCAGCCTCGACCTCCTGGGCTCAAGCAATCCTCCCAACTGAGCCTC
CCCAGTAGCTGGGGCTACAAGCGCATGCCACCACGCCTGGCTATTTTTTTTTTTTTTTTTTTGAGAAGGAGTTTC
ATTCTTGTTGCCCAGGCTGGAGTGCAATGGCACAGTCTCAGCTCACTGCAGCCTCCGCCTCCTGGGTTCAAGCGATTCT
CCTGCCTCAGCCTCCCGAGTAGCTGGGATTATAGGCACCTGCCACCATGCCTGGCTAATTTTTTGTATTTTTAGTAGG
GATGGGGTTTCACCATGTT

SEQ ID:28
>STAR28
AGGAGGTTATTCCTGAGCAAATGGCCAGCCTAGTGAACTGGATAAATGCCCATGTAAGATCTGTTTACCCTGAGAAGGG
CATTTCCTAACTCTCCCTATAAAATGCCAAGTGGAGCACCCCAGATGAAATAGCTGATATGCTTTCTATACAAGCCATC
TAGGACTGGCTTTATCATGACCAGGATATTCACCCACTGAATATGGCTATTACCCAAGTTATGGTAAATGCTGTAGTTA
AGGGGGTCCCTTCCACATGGACACCCCAGCTTATAACCAGAAAGGGTTCCCAATCTAGACTCCAAGAGAGGGTTCTTAG
ACCTCATGCAAGAAAGAACTTGGGGCAAGTACATAAAGTGAAAGCAAGTTTATTAAGAAAGTAAAGAAACAAAAAAATG
GCTACTCCATAACCAAAGTTATTTCTCACTTATATGATTAATAAGAGATGGATTATTCATGAGTTTTCTGGGAAAGGGG
TGGGCAATTCCTGGAACTGAGGGTTCCTCCCACTTTTAGACCATATAGGGTATCTTCCTGATATTGCCATGGCATTTGT
AAACTGTCATGGCACTGATGGGAGTGTCTTTTAGCATTCTAATGCATTATAATTAGCATATAATGAGCAGTGAGGATGA
CCAGAGGTCACTTCTGTTGCCATATTGGTTTCAGTGGGGTTTGGTTGGCTTTTTTTTTTTTTAACCACAACCTGTTTT
TTATTTATTTATTTATTTATTTATTTATATTTTTATTTTTTTTAGATGGAGTCTTGCTCTGTCACCCAGGTTA
GAGTGCAGTGGCACCATCTCGGCTCACTGCAAGCTCTGCCTCCTTGGTTCACGCCATTCTGCTGCCTCAGCCTCCCGAG
TAGCTGGGACTACAGGTGCCTGCCACCATACCCGGCTAATTTTTTCTATTTTTCAGTAGAGACGGGGTTTCACCGTGTT
AGCCAGGATGGTC

SEQ ID:29
>STAR29
AGCTTGGACACTTGCTGATGCCACTTTGGATGTTGAAGGGCCGCCCTCTCCCACACCGCTGGCCACTTTTAAATATGTC
CCCTCTGCCCAGAAGGGCCCCAGAGGAGGGGCTGGTGAGGGTGACAGGAGTTGACTGCTCTCACAGCAGGGGGTTCCGG
AGGGACCTTTTCTCCCCATTGGGCAGCATAGAAGGACCTAGAAGGGCCCCCTCCAAGCCCAGCTGGGCGTGCAGGGCCA
GCGATTCGATGCCTTCCCCTGACTCAGGTGGCGCTGTCCTAAAGGTGTGTGTGTTTTCTGTTCGCCAGGGGGTGGCGGA
TACAGTGGAGCATCGTGCCCGAAGTGTCTGAGCCCGTGGTAAGTCCCTGGAGGGTGCACGGTCTCCTCCGACTGTCTCC
ATCACGTCAGGCCTCACAGCCTGTAGGCACCGCTCGGGGAAGCCTCTGGATGAGGCCATGTGGTCATCCCCTGGAGTC
CTGGCCTGGCCTGAAGAGGAGGGGAGGAGGAGGGCCAGCCCTCCCTAGCCCCAAGGCCTGCGAGGCTGCAAGCCCGGCC
CCACATTCTAGTCCAGGCTTGGCTGTGCAAGAAGCAGATTGCCTGGCCCTGGCCAGGCTTCCCAGCTAGGATGTGGTAT
GGCAGGGGTGGGGGACATTGAGGGGCTGCTGTAGCCCCCACAACCTCCCCAGGTAGGGTGGTGAACAGTAGGCTGGACA
AGTGGACCTGTTCCCATCTGAGATTCAAGAGCCCACCTCTCGGAGGTTGCAGTGAGCCGAGATCCCTCCACTGCACTCC
AGCCTGGGCAACAGAGCAAGACTCTGTCTCAAAAAAACAGAACAACGACAACAAAAAACCCACCTCTGGCCCACTGCCT
AACTTTGTAAATAAAGTTTTATTGGCACATAGACACACCCATTCATTTACATACTGCTGCGGCTGCTTTTGCATTACCC
TTGAGTAGACGACAGACCACGTGGCCATGGAAGCCAAAAATATTTACTGTCTGGCCCTTTACAGAAGTCTGCTCTAGAG
GGAGACCCCGGCCCATGGGGCAGGACCACTGGGCGTGGGCAGAAGGGAGGCCTCGGTGCCTCCACGGGCCTAGTTGGGT
ATCTCAGTGCCTGTTCTTGCATGGAGCACCAGGGGTCAGGGCAAGTACCTGGAGGAGGCAGGCTGTTGCCCGCCCAGC
ACTGGGACCCAGGAGACCTTGAGAGGCTCTTAACGAATGGGAGACAAGCAGGACCAGGGCTCCCATTGGCTGGGCCTCA
GTTTCCCTGCCTGTAAGTGAGGGAGGGCAGCTGTGAAGGTGAACTGTGAGGCAGAGCCTCTGCTCAGCCAGTTGCAGGGG
CGGCTCTGCCCCACTCCTGTTGTGCACCCAGAGTGAGGGGCACGGGTGAGATGTCACCATCAGCCCATAGGGTGTCC
TCCTGGTGCCAGGTCCCCAAGGGATGTCCCATCCCCCTGGCTGTGTGGGGACAGCAGAGTCCCTGGGGCTGGGAGGGC
TCCACACTGTTTTGTCAGTGGTTTTTCTGAACTGTTAAATTTCAGTGGAAAATTCTCTTTCCCCTTTTACTGAAGGAAC
CTCCAAAGGAAGACCTGACTGTGTCTGAGAAGTTCCAGCTGGTGCTGGACGTCGCCCAGAAAGCCCAGTACTGCCACG
GGCGCCGGCCAGGGGTGTGTCTGCGCCAGCCATGGGCACCAGCCAGGGGTGTGTCTACGCCGGCCAGGGGTAGGTCTCC
GCCGGCCTCCGCTGCTGCCTGGGGAGGGCCGTGCCTGACACTGCACGCCCGGTTTGTCCGCCGTCAGCTGACTTGTAGT
CACCCTGCCCTTGGATGGTCGTTACAGCAACTCTGGTGGTTGGGGAAGGGGCCTCCTGATTCAGCCTCTGCGGACGGTG
CGCGAGGGTGGAGCTCCCCTCCCTCCCCACCGCCCCTGGCCAGGGTTGAACGCCCTGGGAAGGACTCAGGCCCGGGTC
TGCTGTTGCTGTGAGCGTGGCCACCTCTGCCCTAGACCAGAGCTGGGCCTTCCCCGGCCTAGGAGCAGCCGGGCAGGAC
```

FIG. 26 (CONT)

CACAGGGCTCCGAGTGACCTCAGGGCTGCCCGACCTGGAGGCCCTCCTGGCGTCGCGGTGTGACTGACAGCCCAGGAGC
GGGGGCTGTTGTAATTGCTGTTTCTCCTTCACACAGAACCTTTTCGGGAACATGGCTGACATCCTGCAGAAGATCAAGA
AGTAAGTCCCGCCCCCCACCC

SEQ ID:30
>STAR30
CCTCCCCTGGAGCCTTCAGAAGGAGCATGGCATAGGAGTCTTGATTTCAGACGTCTGGTCCCCAGAATGATGGGAGAAT
GAATTTCTGTTATTTAAGCCACCCAACCTGTGGTGCTTTGTTATAGCAGCCTCAGGAAACTAACACACTGCACGTGCCC
ACTATTCCCTTTTCCAGTATCTTTCAGGACTTGCTGGCTTCCTTTGTTCTGGCGTACACCCATGCATGGCCCCATTCCC
CACTTCCTAAAACAACAACCCTGACTTAGTCTGTTTGGGCTGCTAGAACAAAATACTATAGACTGGGTGACTTATAAAC
AACAGAAATTCATTTCTCACATTCTGGAGGCTGGGAAGTCCAATATCGAGGCACCATCACATTTGGTCTCTGCTGAGGC
CCCCTTCCTAGCTCCTCACTGTGTCCTTACATGGCAGAAGGGGCAAGGCAGCTCTCTGGGGTCCCTTTTCAAGGCCACA
AATCCCATTCATTAGGGCTGATGACTTCATGACTTAATCACCTCCTAATGGCCCCACCTCCTAATCGCATTGGGCGTTA
GGATTCAACATAAATTTTGGGGGGACACACATATTCAGACCATAGCAAACCCCAACAATAAAAAACCTTCACTTTAAGG
TTCCAAATGGACTGGCAGTTAAATCATGTTCATATTTACATAAAAGAAGGAGTAAGTCAACAAATTGATAAACGCGTGG
AGATTTGTTCGGATGGATGTTCACCAAAATGCTGGCCTTAAAGAGTGAGATGGGAAATCGGAACTATTACATTCTTCTT
CATACTTTTTGGTACTGCCTGCATTGTTAAAAAAAAAAAAAAGAGCACAGAGCATTTTTACAATCAGGAAAAAAACAA
TGAGGTTATCTTCATTCTGGAAAAAAATGGAAAATGAAACAGTGGAGTCACATCATGGAAAATGCTTATGGTACAATTT
CATGTGACATAAAACAATAGAATAGAGGACCTGTTTTATGACTAAAGCACTGTAAAAATGACAGGCCTGGAAGGAGAGA
TGAAAACCACTCATTTGTTAAGGTAGTCAGGTGGCAGGTGATTTCTCTTCTTTTGAAAATTTCCATTTTCATTATATCG
CAGTTTGTGCATTTACTAAAACTTTCGGTTGGTACACATGCATAAATAGATAGATAAATAAGTAGATAGATGATAGATA
AATAGACGGTAGGTAGATAGATAGATAGATATGAGAAATAAGTCCCCTGTACTTGGCCTTGCAGCCATAACTAGTCATT
CCCCTTCCTCTGTCCATTGCTATGCCTGATGGACAAGGCAGTCTGTGCCCTCTGGCCCCAATTCCAATGTGCCCTCTGC
TCCTGGCTGTTAGTCCCTTTCCACCCCAATACAATTGCTCCGAGGTCACTTCTAAGTGTGAAGCCCCCAGATCAGATGG
CTTCTTCTGTGTCCTTACCTTACCCAATTTCTAATTATAACTAAAACACAATGAGGCTCTAGTAAAATACCATGAGACT
TCAGGCCCTCTGTATAACTTCACTCATTTAAACCTAACAAGGAAAACCTACCATGAATCCGAGGCACAGAGCAGCTAAG
GAACTCACCAAGGTCACGCAGCTATTGGTGATGGAACCATGAGTCAAGCTTCACAGCCTGTTGGCTCTAGAATAGGGTT
TCCCAACCTCAGCACTGTGGACATTTTCAGGCTGGATAATTCTCTGTTGTGGGGGGCTGTTCTGTGCCTTGTAGGATAT
TAGGAGCATCTCTGGCCTCTACCCACTAGACGCAGCAGCACTCCCATGCCCAGTTGTGACAACAAGCAATGTCTCCCAC
CATTGCCAAGTGTCCCCTGGGTGGAAATGCACCC

SEQ ID:31
>STAR31
CACCCGCCTTGGCCCCCCAGAGTGCTGGGATTACAAGTGTAAACCACCATTCCTGGCTAGATTTAATTTTTTAAAAAAT
AAAGAGAAGTAGGAATAGTTCATTTTAGGGAGAGCCCCTTAACTGGGACAGGGGCAGGACAGGGGTGAGGCTTCCCTTA
NTTCAAGCTCACCTCAAACCCACCCAGGACTGTGTGTCACATTCTCCAATAAAGGAAAGGTTGCTGCCCCGCCTGTGA
GTGCTGCAGTGGAGGGTAGAGGGCCGTGGGCAGAGTGCTTCATGGACTGCTCATCAAGAAAGGCTTCATGACAATCGGC
CCAGCTGCTGTCATCCCACATTCTACTTCCAGCTAGGAGAAGGCGGCTTGCCCACAGTCACCCAGCCGGCAAGTGTCAC
CCCTGGGTTGGACCCAGAGCTATGATCCTGCCCAGGGGTCCAGCTGAGAATCAGGCCCACGTTCTAGGCAGAGGGCTC
ACCTACTGGGACTCCAGTAGCTGTAGTGCATGGAGGCATCATGGCTGCAGCAGCCTGGACCTGGTCTCACACTGGCTGT
CCCTGTGGGCAGGCCATCCTCAATGCCAGGTCAGGCCCAAGCATGTATCCCAGACAATGACAATGGGGTGGAATCCTCT
CTTGTCCCAGAAGCCACTCCTCACTGTTCTACCTGAGGAAGGCAGGGGCATGGTGGAATCCTGAAGCCTGCTGTGAGGG
TCTCCAGCGAACTTGCACATGGTCAGCCCTGCCTTCTCCTCCCTGAACTAGATTGAGCGAGAGCAAGAAGGACATTGAA
CCAGCACCCAAAGAATTTTGGGGAACGGCCTCTCATCCAGGTCAGGCTCACCTCCTTTTTAAAATTTAATTAATTAATT
AATTAATTTTTTTTTTAGAGACAGAGTCTTACTGTGTGGCCCAGGCTGTAGTGCAGTGGCACAATCATAGTTCACTGCAG
CCTCAAACTCCCCACCTCAGCCTCTGGATTAGCTGAGACTACAGGTGCACCACCACCACACCCAGCTAATATTTTTATT
TTTGTAGAGAGAGGGTTTCACCATCTTGCCCAGGCTGGTCTCAAACTCCTGGGCTCAAGTGATCCCGCCCAGGTCTGAA
AGCCCCCAGGCTGGCCTCAGACTGTGGGTTTTCCATGCAGCCACCCGAGGGCGCCCCAAGCCAGTTCATCTCGGAGT
CCAGGCCTGGCCCTGGGAGACAGAGTGAAACCAGTGGTTTTTATGAACTTAACTTAGAGTTTAAAAGATTTCTACTCGA
TCACTTGTCAAGATGCGCCCTCTCTGGGGAGAAGGGAACGTGACTGGATTCCCTCACTGTTGTATCTTGAATAAACGCT
GCTGCTTCATCCTGTGGGGGCCGTGGCCCTGTCCCTGTGTGGGTGGGGCCTCTTCCATTTCCCTGACTTAGAAACCACA
GTCCACCTAGAACAGGGTTTGAGAGGCTTAGTCAGCACTGGGTAGCGTTTTGACTCCATTCTCGGCTTTCTTCTTTTTC
TTTCCAGGATTTTTGTGCAGAAATGGTTCTTTTGTTGCCGTGTTAGTCCTCCTTGGAAGGCAGCTCAGAAGGCCCGTGA
AATGTCGGGGACAGGACCCCCAGGGAGGGAACCCCAGGCTACGCACTTTAGGGTTCGTTCTCCACGGAGGGCGACCTG
ACCCCCGNATCCGTCGGNGCGCGNNGNNACNAANNNNTTCCC

SEQ ID:32
>STAR32
GATCACACAGCTTGTATGTGGGAGCTAGGATTGGAACCCCAGAAGTCTGGCCCCAGGTTCATGCTCTCACCCACTGCAT
ACAATGGCCTCTCATAAATCAATCCAGTATAAAACATTAGAATCTGCTTTAAAACCATAGAATTAGTAGCGTAAGTAAT
AAATGCAGAGACCATGCAGTGAATGGCATTCCTGGAAAAAGCCCCCAGAAGGAATTTTAAATCAGCTTTCGTCTAATCT
TGAGCAGCTAGTTAGCAAATATGAGAATACAGTTGTTCCCAGATAATGCTTTATGTCTGACCATCTTAAACTGGCGCTG
TTTTTCAAAAACTTAAAAACAAAATCCATGACTCTTTTAATTATAAAAGTGATACATGTCTACTTGGGAGGCTGAGGTG

FIG. 26 (CONT)

```
GTGGGAGGATGGCTTGAGTTTGAGGCTGCAGTATGCTACTATCATGCCTATAAATAGCCGCTGCATTCCAGCTTGGGCA
ACATACCCAGGCCCTATCTCAAAAAAATAAAAAGTAATACATCTACATTGAAGAAAATTAATTTTATTGGGTTTTTTTG
CATTTTTATTATACACAGCACACACAGCACATATGAAAAAATGGGTATGAACTCAGGCATTCAACTGGAAGAACAGTAC
TAAATCAATGTCCATGTAGTCAGCGTGACTGAGGTTGGTTTGTTTTTTCTTTTTTCTTCTCTTCTCTTTTCTTT
TTTTTTGAGACGGAGCTTTGCTCTTTTTGCCCAGGCTTGATTGCAATGGCGTGATCTCAG
```

SEQ ID:33
>STAR33
```
GCTTTTATCCTCCATTCACAGCTAGCCTGGCCCCCAGAGTACCCAATTCTCCCTAAAAAACGGTCATGCTGTATAGATG
TGTGTGGCTTGGTAGTGCTAAAGTGGCCACATACAGAGCTCTGACACCAAACCTCAGGACCATGTTCATGCCTTCTCAC
TGAGTTCTGGCTTGTTCGTGACACATTATGACATTATGATTATGATGACTTGTGAGAGCCTCAGTCTTCTATAGCACTT
TTAGAATGCTTTATAAAAACCATGGGGATGTCATTATATTCTAACCTGTTAGCACTTCTGTTCGTATTACCCATCACAT
CCCAACATCAATTCTCATATATGCAGGTACCTCTTGTCACGCGCGTCCATGTAAGGAGACCACAAAACAGGCTTTGTTT
GAGCAACAAGGTTTTTATTTCACCTGGGTGCAGGTGGGCTGAGTCTGAAAAGAGAGTCAGTGAAGGGAGACAGGGGTGG
GTCCACTTTATAAGATTTGGGTAGGTAGTGGAAAATTACAATCAAAGGGGTTGTTCTCTGGCTGGCAGGGTGGGGT
CACAAGGTGCTCAGTGGGAGAGCCTTTGAGCCAGGATGAGCCAGAAGGAATTTCACAAGGTAATGTCATCAGTTAAGGC
AGGGACTGGCCATTTTCACTTCTTTTGTGGTGGAATGTCATCAGTTAAGGCAGGAACCGGCCATTTTCACTTCTTTTGT
GATTCTTCACTTGCTTCAGGCCATCTGGACGTATAGGTGCAGGTCACAGTCACAGGGGATAAGATGGCAATGGCATAGC
TTGGGCTCAGAGGCCTGACACCTCTGAGAAACTAAAGATTATAAAAATGATGGTCGCTTCTATTGCAAATCTGTGTTTA
TTGTCAAGAGGCACTTATTTGTCAATTAAGAACCCAGTGGTAGAATCGAATGTCCGAATGTAAAACAAAATACAAAACC
TCTGTGTGTGTGTGTGTGAGTGTGTGTGTATGTGTGTGTGTGTATTAGAGAGGAAAAGCCTGTATTTGGAGGTGT
GATTCTTAGATTCTAGGTTCTTTCCTGCCCACCCCATATGCACCCACCCCACAAAAGAACAAACAACAAATCCCAGGAC
ATCTTAGCGCAACATTTCAGTTTGCATATTTTACATATTTACTTTTCTTACATATTAAAAAACTGAAAATTTTATGAAC
ACGCTAAGTTAGATTTTAAATTAAGTTTGTTTTTACACTGAAAATAATTTAATATTTGTGAAGAATACTAATACATTGG
TATATTTCATTTTCTTAAAATTCTGAACCCCTCTTCCCTTATTTCCTTTTGACCCGATTGGTGTATTGGTCATGTGACT
CATGGATTTGCCTTAAGGCAGGAGG
```

SEQ ID:34
>STAR34
```
ACTGGGCACCCTCCTAGGCAGGGGAATGTGAGAACTGCCGCTGCTCTGGGGCTGGGCGCCATGTCACAGCAGGAGGGAG
GACGGTGTTACACCACGTGGGAAGGACTCAGGGTGGTCAGCCACAAAGCTGCTGGTGATGACCAGGGGCTTGTGTCTTC
ACTCTGCAGCCCTAACACCCAGGCTGGGTTCGCTAGGCTCCATCCTGGGGTGCAGACCCTGAGAGTGATGCCAGTGGG
AGCCTCCCGCCCCTCCCCTTCCTCGAAGGCCCAGGGGTCAAACAGTGTAGACTCAGAGGCCTGAGGGCACATGTTTATT
TAGCAGACAAGGTGGGGCTCCATCAGCGGGGTGGCCTGGGGAGCAGCTGCATGGGTGGCACTGTGGGAGGGTCTCCCA
GCTCCCTCAATGGTGTTCCGGCTCGTGCGGCAGCTGGCGGCACCCTGGACAGAGGTGGATATGAGGGTGATGGGTGGGG
AAATGGGAGGCACCCGACATCGGCACAGCAGAATAAAGACAGCAGCAGTGCTGGGGGGCAGGGGGATGAGCAAAGGCAG
GCCCAAGACCCCCAGCCCACTGCACCCTCGCCTCCCACAAGCCCCTCGCAGCCGCCCAGCCACACTCACTGTGCACTC
AGCCGTCGATACACTGGTCTGTTAGGGACAAAGTCCGTCAGAACAGGCAGCTGTGTGTGTGTGCGTGTATGAGTGTG
TGTGTGTGATCCCTGACTGCCAGGTCCTCTGCACTGCCCCTGGG
```

SEQ ID:35
>STAR35
```
CGACTTGGTGATGCGGGCTCTTTTTTGGTTCCATATGAACTTTAAAGTAGTCTTTTCCAATTCTGTGAAGAAAGTCATT
GGTAGGTTGATGGGCATGGCATTGAATCTGTAAATTACCTTGGGCAGTATGGCCATTTTCACAATGTTGATTCTTCCTA
TCCATGATGATGGAATGTTCTTCCATTAGTTTGTATCCTCTTTTATTTCCTTGAGCAGTGGTTTGTAGTTCTCCTTGAA
GAGGTCCTTCACATCCCTTGTAACTTGGATTCCTAGGTGTATTTTATTCTCTTTGAAGCAAATTGTGAATGGGAGTNCACT
CACGATTTGGCTCTCTGTTTGTCTGCTGGGTGTATAAANAATGTNGTGATNTTNGTACATTGATTTNGTATCCNTGAGA
CTTNGCTGAATTTGCTTNATCNGCTTNNGGGAACCTTTTGGGCTGAAACNATGGGATTTTCTAAATATACAATCATGTC
GTCTGCAAACAGGGAACAATTTGACTTCCTCTTTTCCTAATTGAATACACTTTATCTCCTTCTCCTGCCTAATTGCCCT
GGGCAAAACTTCCAACACTATGNTNGNAATAGGAGNTGGTGAGAGAGGGCATCCCTGTTCTTGTTGCCAGNTTTTCAAA
GGGAATGCTTCCAGTTTTGGCCCATTCAGTATGATATGGGCTGTGGGTNGTGTCATAAATAGCTCTTATNATTTTGAAA
TGTGTCCCATCAATACCTAATTTATTGAAAGTTTTTAGCATGAANGCATNGTTGAATTTGGTCAAAGCTTTTTCTGCA
TCTATGGAAATAATCATGTGGTTTTTGTCTTTGGCTCNTGTTTATATGCTGGATNACATTTATTGATTTGTGTATATNG
AACCCAGCCTNNCATCCCAGGGATGAAGCCCACTTGATCCAAGCTTGGCGCGCNGNCTAGCTCGAGGCAGGCAAAAGTA
TGCAAAGCATGCATCTCAATTAGTCAGCACCCATAGTCCGCCCCTACCTCCGCCCATCCGCCCCTAACTCNGNCCGTTC
GCCCATTCTCGCCCATGGCTGACTAATNTTTTTANNATCCAAGCGGNGCCGCCCTGCTTGANCATTCAGAGTNNAGAGN
NTTGGAGGCCNAGCCTTGCAAAACTCCGGACNGNTTCTNNGGATTGACCCCNNTTAAATATTTGGTTTTTGTNTTTTC
ANNGGNGA
```

SEQ ID:36
>STAR36
```
GATCCCATCCTTAGCCTCATCGATACCTCCTGCTCACCTGTCAGTGCCTCTGGAGTGTGTGTCTAGCCCAGGCCCATCC
CCTGGAACTCAGGGGACTCAGGACTAGTGGGCATGTACACTTGGCCTCAGGGGACTCAGGATTAGTGAGCCCCACATGT
```

FIG. 26 (CONT)

ACACTTGGCCTCAGTGGACTCAGGACTAGTGAGCCCCACATGTACACTTGGCCTCAGGGGACTCAGGATTAGTGAGCCC
CCACATGTACACTTGGCCTCAGGGGACTCAGGATTAGTGAGCCCCACATGTACACTTGGCCTCAGGGGACTCAGGACTA
GTGAGCCCCACATGTACACTTGGCCTCAGGGGACTCAGAACTAGTGAGCCCCACATGTACACTTGGCCTCAGGGGACTC
AGGATTAGTGAGCCCCACATGTACACTTGGACACGTGAACCACATCGATGTGCTGCAGAGCTCAGCCCTCTGCAGATGA
AATGTGGTCATGGCATTCCTTCACAGTGGCACCCCTCGTTCCCTCCCCACCTCATCTCCCATTCTTGTCTGTCTTCAGC
ACCTGCCATGTCCAGCCGGCAGATTCCACCGCAGCATCTTCTGCAGCACCCCCGACCACACACCTCCCCAGCGCCTGCT
TGGCCCTCCAGCCCAGCTCCCGCCTTTCTTCCTTGGGGAAGCTCCCTGGACAGACACCCCCTCCTCCCAGCCATGGCTT
TTTCCTGCTCTGCCCCACGCGGGACCCTGCCCTGGATGTGCTACAATAGACACATCAGATACAGTCCTTCCTCAGCAGC
CGGCAGACCCAGGGTGGACTGCTCGGGGCCTGCCTGTGAGGTCACACAGGTGTCGTTAACTTGCCATCTCAGCAACTAG
TGAATATGGGCAGATGCTACCTTCCTTCCGGTTCCCTGGTGAGAGGTACTGGTGGATGTCCTGTGTTGCCGGCCACCTT
TTGTCCCTGGATGCCATTTATTTTTTTCCACAAATATTTCCCAGGTCTCTTCTGTGTGCAAGGTATTAGGGCTGCAGCG
GGGGCCAGGCCACAGATCTCTGTCCTGAGAAGACTTGGATTCTAGTGCAGGAGACTGAAGTGTATCACACCAATCAGTG
TAAATTGTTAACTGCCACAAGGAGAAAGGCCAGGAAGGAGTGGGGCATGGTGGTGTTCTAGTGTTACAAGAAGAAGCCA
GGGAGGGCTTCCTGGATGAAGTGGCATCTGACCTGGGATCTGGAGGAGGAGAAAAATGTCCCAAAAGAGCAGAGAGCCC
ACCCTAGGCTCTGCACCAGGAGGCAACTTGCTGGGCTTATGGAATTCAGAGGGCAAGTGATAAGCAGAAAGTCCTTGGG
GGCCACAATTAGGATTTCTGTCTTCTAAAGGGCCTCTGCCCTCTGCTGTGTGACCTTGGGCAAGTTACTTCACCTCTAG
TGCTTTGGTTGCCTCATCTGTAAAGTGGTGAGGATAATGCTATCACACTGGTTGAGAATTGAAGTAATTATTGCTGCAA
AGGGCTTATAAGGGTGTCTAATACTAGTACTAGTAGGTACTTCATGTGTCTTGACAATTTTAATCATTATTATTTTGTC
ATCACCGTCACTCTTCCAGGGGACTAATGTCCCTGCTGTTCTGTCCAAATTAAACATTGTTTATCCCTGTGGGCATCTG
GCGAGGTGGCTAGGAAAGCCTGGAGCTGTTTCCTGTTGACGTGCCAGACTAGT

SEQ ID:37
>STAR37
ATCTCTCTCTGCCAAAGCAACAGCGGTCCCTGCCCCAACCAGACTACCCCACTCAGTGGGGTTACGGATGCTGCTCCAG
CATCCTAACACTGCCCAGCTGGTGCCTGCCTGTGCTCACCCACAACCCCCAGGCCGGCCTTCCCTGCAGCCTGGGCTTG
GCCACCTTGGCCTGATTGAGCACTGAGGCCTCCTGGGCACCCAGCCCCATCACTGCACCTGCTGCTTCCAGCCCCACCC
CACCGGCTCAGGGGTTCTTCCCAGCGGCGCTGATCATGAAGTCAACATGCACGCAAGTCGTCTCAGGAAACTTTTTAAT
GAAAGTGTCGGCCACGGTGGTGTGTAGGTGGCTGAGCTCAGATTGCAGCTGCTAAGACACCAGCCACTTACCAAGAGAA
AGCCAGGCTGCTTCAAACCCAGGGCCGGAGGCAAAAAAGCATCACTTCCAGCCGGGGAGTCTGGAAGCCACGCCTTGTG
GGAGGTCACACTGGCATCTAGGCCTTCGCCTGCACTGCAGAAGGAGAGCCGGGTCCCCCTCCTGGAGAACGCTGCGTTC
CCCAGCCCCACACCGGCTTTGCCACCACACAGGCTGTTGAGGCAGGAGGCGGGTAAGACGTAGCTGTAGACCCAAAGCA
ACCACCAGCCCTGGGACCCTGCGGGAGAGGAGCACTTTTAGAACATGGAAAAATGTGGTCATCCCATCATTAGACAGCA
CACATCCTACATAAATAAAAAGTCGTATGGGGAAGGAGGTTGGGGAGGGAATAAAAAATTGGCACAGACATTGATAGAC
TGGTTTCCAGTTTCAAGGTAACAGATGCACATCATGAGACCAGAGGAGGCAGAGACAAGGGCTGAATTTGGCTTTTCTA
AGCAACATGTGTTCCTGCGCAGGGCTGAATGGTCGCTGAGACAGAGATGGAAGCCAGGACAAGGGAGCCCACCGGGCCC
AGATAGGTACAGAGAGCAGAGGCTCCTGTTCTGTCCTCGCCACCCATGAGGGTGACACTGCTTGTAAATGGTGGCTGTG
CTCTCCCAGCAAGAAAAAGCACAACTAAATCCACACTGCACACAGACGCAGACAGAAAGCCTTCAAGTGGCTCTGTTT
TCTGCTCCCTGCCTTGCCAGGTCCACAAGCAGAGAGGAGTGTCAGGCACATGGCCCCGCTGTCAGGCTCCCCAGTGAGC
TGTAGGCTCAGCAGGAGCTGCCCACTGACACACAGGGGACACCCACTCCTGCCACCTTGGGAGCGGTTGCCAGACAGAG
CCGCACTGGGTGCTGGTGTCATCCAGGGACCCCACACACTTCCTTAAATGTGATCCT

SEQ ID:38
>STAR38
GATCTATGGGAGTAGCTTCCTTAGTGAGCTTTCCCTTCAAATACTTTGCAACCAGGTAGAGAATTTTGGAGTGAAGGTT
TTGTTCTTCGTTTCTTCACAATATGGATATGCATCTTCTTTTGAAAATGTTAAAGTAAATTACCTCTCTTTTCAGATAC
TGTCTTCATGCGAACTTGGTATCCTGTTTCCATCCCAGCCTTCTATAACCCAGTAACATCTTTTTTGAAACCAGTGGGT
GAGAAAGACACCTGGTCAGGAACGCGCGACCACAGGACAACTCAGGCTCACCCACGGCATCAGACTAAAGGCAAACAAGG
ACTCTGTATAAAGTACCGGTGGCATGTGTATNAGTGGAGATGCAGCCTGTGCTCTGCAGACAGGGAGTCACACAGACAC
TTTTCTATAATTTCTTAAGTGCTTTGAATGTTCAAGTAGAAAGTCTAACATTAAATTTGATTGAACAATTGTATATTCA
TGGAATATTTTGGAACGGAATACCAAAAAATGGCAATAGTGGTTCTTTCTGGATGGAAGACAAACTTTTCTTGTTTAAA
ATAAATTTTATTTTATATATTTGAGGTTGACCACATGACCTTAAGGATACATATAGACAGTAAACTGGTTACTACAGTG
AAGCAAATTAACATATCTACCATCGTACATAGTTACATTTTTTTGTGTGACAGGAACAGCTAAAATCTACGTATTTAAC
AAAAATCCTAAAGACAATACATTTTTATTAACTATAGCCCTCATGATGTACATTAGATCGTGTGGTTGTTTCTTCCGTC
CCCGCCACGCCTTCCTCCTGGGATGGGGATTCATTCCCTAGCAGGTGTCGGAGAACTGGCGCCCTTGCAGGGTAGGTGC
CCCGGAGCCTGACCCGGGNACTTTAANATCAGACGCTTGGGGGCCGGCTGGGAAAAACTGGCGGAAAATATTATAACTG
NACTCTCAATGCCAGCTGTTGTAGAAGCTCCTGGGACAAGCCGTGGAAGTCCCCTCAGGAGGCTTCCCCGATGTCCTAG
GTGGCTGCTCCGCCCGCCACGGTCATTTCCATTGACTCACACGCGCCGCCTGGAGGAGGAGGCTGCGCTGGACACGCCG
GTGGCGCCTTTGCCTGGGGGAGCGCAGCCTGGAGCTCTGGCCGGCAGCGCTGGGAGCGGGGCCTCGGAGGCTGGGCCTGG
GGACCCAAGGTTCGGCGGGGCCCAGGAGGTGGGCTCAGGGTTCTCCAGAGAATCCCCATGAGCTGACCCGCAGGGCGGC
CGGGCCAGTAGGCACCGGGCCCCCGCGGTGACCTGCGGACCCGAAGCTGGAGCAGCCACTGCAAATCCTGCGCTGACCC
CAAATGCTGTGTCCTTTAAATGTTTTAATTAAGAATAATTAATAGGTCCGGGTGTGGAGGCTCAAGCCTTAATCCCCAG
CACCTGGCGAGGCCGAGGAGGGA

FIG. 26 (CONT)

SEQ ID:39
>STAR39
TCACTGCAACCTCCACCTCCCAGGTTCAAGTGATTCTCCTGCCTCGGCCTCCCGAGTAGCTGGGACTACAGGTGCATGA
CACCGCACCTGGCTAGTTTTTGTATTTTTAGTAGAGACAGGGTTTCACTATGTTGGCCAGGTTGGTCTCGAACTCCTGA
CCTTGTGATCCGCCCACCTCGGCCTCCCAAAGTGCTGGGATTACAGAGTGAGCCACTGCGCCTGGCCTGCACCCCTTAC
TATTATATGCTTTGCATTTTCTTTTAGATTTGAAGAACCTCATTATAAACTCTAGCACTAATCTTATGTCAGTTAAATG
CATAGCAAATATCTCCTGACGTGGGAGAATATATATTTGCAAGTCTTCTTGTGAACATATGTTTTCAGTTCTAGGGAGC
CAGACGCCTATGAGTGAAAAGCCTAGTCATCGTGGAGAAGTGCATTCAACTTTGTAAGAAACTGCCAAACCTTTATTCA
TAATGGTTGTATAAATTTTACATTACCACCAATAATGTATGAGAGTTCCAGTTGCTTCACATCCTCACCAGCATTTTGT
TTTGTCTGTCTTTTTTCCTTTGGTTATTCTAGTGGGCATAAGATATAATAGTATCCCTTGTGGTTTAATGTAAATTCCA
CTGAAGACTAATAACATTTGCATATTTCTAATTAATAAGCCTTTTTAAGTGACTTTTCAAGTCTTTTGCTCATTTTTATT
AGATATTTGCCTTCTTATTATTGATTTGAAAGAATTATATTTATATGCTTATATTCTGGTTATAAGCCCTTTGTCATTA
TTTTCCAAAACAATATTTGGTTGTTTCTGTACTACTTTCCTTGCTCCTTTGAATTGACTTGGTGCCTTGGCCAAAAATC
AATTGACCACATACATGTGGGTGCATCCAGACTACCACATTCCGTTTATCTATTTGTCTCTCCTTGTGTCAATAACA
CTCTGTCTTGATAATGGTAAGTTTTGAGATCAGGTTGTGTAAGTCCTCCTAATTTTTCCTGGGTTTTCAATATTGCTTT
GCTTTTTAAAAATTTTGTATTTTCATTTACATTTAAAATAAACTTGTTAGTGGGATTTTGATTGGCATTGCACTGAAC
TCGTGGATCAATTTGGGGAGATTGGACATTCTTATATATGGATCCCGTGGTCATCAACTTTAAGAACTCTTTCTCATCC
ATTAGTAACTCAATCTAGGTTCAGATGCTACTCGTTTTCTGCTCAGTCTGTGTCTGAGCCCCTTATGCTCTTCATTTTG
TCATCCAATTAACCTCAGCTTTGCATCAATACTATTTCTTGCTTTGGTGCCTGTTACCTCTCCTCTAATCACCAATCCA
CAACTTACCTCCAAATTCAGGGCTTGTCTCATTCTTCCCAGGAGGAGTGCTGCTCAGTCTATCTACTTAGTATTATAAT
TTCTCTGGCTTGGTATCAAGGCACTCCCATTTCCGGCTTCCATGAGATGTCTCAGAGGGCATGCTGCCCGGTGTAGCTG
CATGGTCAAGCTTCTTCATATCTCTTGCCTCATCACTTAAACTCACTATTTTGTACTCCTGCTTCAGCTATAGGGAGCT
ACTGTTAGTTTCTTGAAGACATATGCTCTCTCTCTCTCACATCTGGACCTGAGCACATCCTGTTACTGCTGCTTGAA
ACAATGTGATCCCCAGGCACACACCATTAGCTTAGAAGCCTCCCCTGATTCTTCAAGGCTGGTTGAGTCCCTTCTCTGT
GCTCTCATGACAACAGTTGGCAATTCCTCGTTGCAGCCACCTAGCCCATGATGCTCTTTGGAGGCAGAGACTGAGTCTTT
CTCACTATTGAATTTCCAGCATTCATCACAGAGCCTGGCATATATAAAGCCCTCCATCATATGTATTAAGTGAATGGAT
AAATGAAAAAAGTTATATATATGTACATATATGTGTATATATGTATATGTATATATGTGTATATATGTGTGTATATGT
GTGTGTATATATGTACATATATATGTATCTATGTACATATATGTATATATGTATATATATGTGTGTGTATATGTGTGTG
TGTATGTATATATATTACAATGAAATACTATTCAGCCTTAAAAAGGCAGGGAATCCTGTCATTTAACACAATATGGATA
AACCTAGAGGACTCTAAAGGCAAATACCACATGTTCTCACTCACAAAATCTAAACAAGTTGAACTCCTACAAGTAGAGA
GTAGGATGATGGTTACCAAGGGCTGGGGACGGGAGAGGATGGGGAAAGCATAGCTGTCCATCAAAGGGTAGAAAGTTT
CATTTAGACAAGAGGAATCAGCTTTAGTGATCTATTTCAC

SEQ ID:40
>STAR40
GCTGTGATTCAAACTGTCAGCGAGATAAGGCAGCAGATCAAGAAAGCACTCCGGGCTCCAGAAGGAGCCTTCCAGGCCA
GCTTTGAGCATAAGCTGCTGATGAGCAGTGAGTGTCTTGAGTAGTGTTCAGGGCAGCATGTTACCATTCATGCTTGACT
TCTAGCCAGTGTGACGAGAGGCTGGAGTCAGGTCTCTAGAGAGTTGAGCAGCTCCAGCCTTAGATCTCCCAGTCTTATG
CGGTGTGCCCATTCGCTTTGTGTCTGCAGTCCCCTGGCCACACCCAGTAACAGTTCTGGGATCTATGGGAGTAGCTTCC
TTAGTGAGCTTTCCCTTCAAATACTTTCCAACCAGGTAGAGAATTTTGGAGTGAAGGTTTTGTTCTTCGTTTCTTCACA
ATATGGATATGCATCTTCTTTTGAAAATGTTAAAGTAAATTACCTCTCTTTTCAGATACTGTCTTCATGCGAACTTGGT
ATCCTGTTTCCATCCCAGCCTTCTATAACCCAGTAACATCTTTTTTGAAACCAGTGGGTGAGAAAGACACCTGGTCAGG
AACGCGGACCACAGGACAACTCAGGCTCACCCACGGCATCAGACTAAAGGCAAACAAGGACTCTGTATAAAGTACCGGT
CGCATCTGTATTAGTGGAGATGCAGCCTGTGCTCTGCAGACAGGGAGTCACACAGACACTTTTCTATAATTTCTTAAGT
GCTTTGAATGTTCAAGTAGAAAGTCTAACATTAAATTTGATTGAACAATTGTATATTCATGGAATATTTTGGAACGGAA
TACCAAAAAATGGCAATAGTGGTTCTTTCTGGATGGAAGACAAACTTTTCTTGTTTAAAATAAATTTTATTTTATATAT
TTGAGGTTGACCACATGACCTTAAGGATACATATAGACAGTAAACTGGTTACTACAGTGAAGCAAATTAACATATCTAC
CATCGTACATAGTTACATTTTTTTGTGTGACAGGAACAGCTAAAATCTACGTATTTAACAAAAATCCTAAAGACAATAC
ATTTTTATTAACTATAGCCCTCATGATGTACATTAGATCTCTAA

SEQ ID:41
>STAR41
TGCTCTTGTTGCCCAGGCTGCAGTGCAATGGCGCTGTCTCGGCTCATCGCAACCTCCGCCTCCCAGATTCAAGTGATTC
TCCTGCCTCACCCTCCCAAGTAGCTGGGATTACCAGTATGCAGCAACACGCCCGGCTAATTTTGTATTTGTAATAGAGA
CGGGGTTTCTTCATGTTGGTCAGGCTGGTCTCAAATTCCTGCCCTCAGGTGATCTGCCCACCTTGGCCTCCCAAAGTGC
TGGGATTACAGGCATGAGCCACTGTGCCCGGCCTGGGCTGGGGCTTTAAGGGGACTGGAGGGTGAGGGGCTGGAAAAT
TGGGAGAGTTGATTGGTGGGGCAAGGGGATGTAATCATCAGGGTGTACAAACTGCACTCTTGGTTTAGTCAGCTCCTC
GTGGGGTCCTTCGGAGCAGCTCAGTCAGTAGCTCCATCAGTATACAGGACCCAAAGGAATATCTCAAAGGGAAAACAGC
ATTTCCTAAGGTTCAAGTTGTGATCTACGGAGCAGTTAGGGGAACTACAATCTTGTGACAGGGTCTACATGCTTCTGAG
GCAATGAGACACCAAGCAGCTACGAGGAAGCAGTCAGAGAGCACGCCGACCTAGTGACTGATGCTGATGTGCTGCCAGC
TGGGTTCATTTTCATTTCTCCCCTCCCCCTGCCCTCATTAATTTTGTAAAGTTTATAGGGAACATTTCACCCACTCTGC
TGTGGATCCCTGTCACTTACGGAGTCTGTCATCTTGGCTGTATGGGCTGTGGCCTCTGCGGTGCCCATTCTCAGGAGGT
GTGAGACCCATGAGGACCGGAGGTGGACAAGGCTAGAGACCACACCCCCCGCTCCATCCAATCATGTTTTCCTGGGTG

FIG. 26 (CONT)

```
CTTGGTTTCTATGCAGGCTGCATGTCCTTAGTCCCTGCATGGGAACAGCTCCTGTGGTGAGCAGGCCCCTGAGGAAGGC
CTTGAGCGGGAATGGAGCCTAGGCTTAGGCTGCCTGGTAAGAGCTGGAGGGAACCAGCCGAGGCTTGTGCTACTTTTTT
TTCCAGAATGAAATACGTGACTGATGTTGGTGTCCTGCAGCGCCACGTTTCCCGCCACAACCACCGGAACGAGGATGAG
GAGAACACACTCTCCGTGGACTGCACACG

SEQ ID:42
>STAR42
AAGGGTGAGATCACTAGGGAGGGAGGAAGGAGCTATAAAAGAAAGAGGTCACTCATCACATCTTACACACTTTTTAAAA
CCTTGGTTTTTTAATGTCCGTGTTCCTCATTAGCAGTAAGCCCTGTGGAAGCAGGAGTCTTTCTCATTGACCACCATGA
CAAGACCCTATTTATGAAACATAATAGACACACAAATGTTTATCGGATATTTATTGAAATATAGGAATTTTTCCCCTCA
CACCTCATGACCACATTCTGGTACATTGTATGAATGAATATACCATAATTTTACCTATGGCTGTATATTTAGGTCTTTT
CGTGCAGGCTATAAAAATATGTATGGGCCGGTCACAGTGACTTACGCCCGTAGTCCCAGAACTTTGGGAGGCCGAGGCG
GGTGGATCACCTGAGGTCGGGAGTTCAAAACCAGCCTGACCAACATGGAGAAACCCCGTCTCTGCTAAAAATACAAAAA
TTAACTGGACACGGTGGCGTATGCCTGTAATCCCAGCTACTCGGGAAGCTGAGGCAGGAGAACTGCTTGAACCCAGGAG
GCGGAGGTTGTCGTGAGTCGAGATTGCGCCATTGCACTCCAGCCTGGGCAACAAGAGCGAAATTCCATCTCAAAAAAAA
GAAAAAAGTATGACTGTATTTAGAGTAGTATGTGGATTTGAAAAATTAATAAGTGTTGCCAACTTACCTTAGGGTTTAT
ACCATTTATGAGGGTGTCGGTTTC

SEQ ID:43
>STAR43
CAAATAGATCTACACAAAACAAGATAATGTCTGCCCATTTTTCCAAAGATAATGTGGTGAAGTGGGTAGAGAGAAATGC
ATCCATTCTCCCCACCCAACCTCTGCTAAATTGTCCATGTCACAGTACTGAGACCAGCGGGCTTATTCCCAGCGGGCAG
AATGTGCACCAAGCACCTCTTGTCTCAATTTGCAGTCTAGGCCCTGCTATTTGATGGTGTGAAGGCTTGCACCTGGCAT
GGAAGGTCCGTTTTGTACTTCTTGCTTTAGCAGTTCAAAGAGCAGGGAGAGCTGCGAGGGCCTCTGCAGCTTCAGATGG
ATGTGGTCAGCTTGTTGGAGGCGCCTTCTGTGGTCCATTATCTCCAGCCCCCTGCGGTGTTGCTGTTTGCTTGGCTTG
TCTGGCTCTCCATGCCTTGTTGGCTCCAAAATGTCATCATGCTGCACCCCAGGAAGAATGTGCAGGCCCATCTCTTTTA
TGTGCTTTGGGCTATTTTGATTCCCCGTTGGGTATATTCCCTAGGTAAGACCCAGAAGACACAGGAGGTAGTTGCTTTG
GGAGAGTTTGGACCTATGGGTATGAGGTAATAGACACAGTATCTTCTCTTTCATTTGGTGAGACTGTTAGCTCTGGCCG
CGGACTGAATTCCACACAGCTCACTTGGGAAAACTTTATTCCAAAACATAGTCACATTGAACATTGTGGAGAATGAGGG
ACAGAGAAGAGGCCCTAGATTTGTACATCTGGGTGTTATGTCTATAAATAGAATGCTTTGGTGGTCAACTAGACTTGTT
CATGTTGACATTTAGTCTTGCCTTTTCGGTGGTGATTTAAAAATTATGTATATCTTGTTTGGAATATAGTGGAGCTATG
GTGTGGCATTTTCATCTGGCTTTTTGTTTAGCTCAGCCCGTCCTGTTATGGGCAGCCTTGAAGCTCAGTAGCTAATGAA
GAGGTATCCTCACTCCCTCCAGAGAGCGGTCCCCTCACGGCTCATTGAGAGTTTGTCAGCACCTTGAAATGAGTTTAAA
CTTGTTTATTTTTAAAACATTCTTGGTTATGAATGTGCCTATATTGAATTACTGAACAACCTTATGGTTGTGAAGAATT
GATTTGGTGCTAAGGTGTATAAATTTCAGGACCAGTGTCTCTGAAGAGTTCATTTAGCATGAAGTCAGCCTGTGGCAGG
TTGGGTGGAGCCAGGGAACAATGGAGAAGCTTTCATGGGTGG

SEQ ID:44
>STAR44
TGAGTTGGGGTCCTAAGCCAGAAGTTAACTATGCTTTCATATATTCTTGCAAGTAGAAGTACAGTGTTGGTGTAAATTC
CCCTTAGATGGATAGCTAAGCCCAGAGGAAATAATGGTAATTGGAACCATATGACCGTATGCAATTCATGTGCATATTT
ATATCAAGAAAAGAACATTATAGGTCGGGTGAGACCCTATTTTGTTCTGACAATGTCATCTGTATTTACATGTCTGTTT
CGGGAGTTTGGATGTCAAGGGATTCTGTGCTGGATTGTAAAGCATGTGCTTCTGCTTGATGTAGCTACTCAATTTTGTA
TTCTTGACTAATAAAGTCATAAACATAATTCAACCTCTGTGTGCGTGCTCTCCTTCCATTAATTTATACTTTAGCAAAA
AGTATTGAATGTGTGTTTATGTAACAATTTCCTATAAATTATATTAAATGATTTATTAGCTTTATTCAATAAAGTTTT
AAGTGTTTTCTTCTATGACTACATTATTTGTTAACAAGAAATTTCTTTAACTGAAAACTTCAAGGAAGACTATCTGGGT
AACTCTTTCAAAAAGAATTGTCCCTGTATTTTGGGATTGAATATATTAATTTCTTGTACTGTTTTAACAGCACATAATT
TTACAAGACAAGCCACTTTTTCAAAGCCTGCTTCTCCTCCCATTTTCCCTATCTCTGTGATTGACACCTCCAACCCCTG
TAGCCTGCCTCTGCTCTCTCTTAACCAGTCCTACTGATACTACTTCCTAAGTATTTTTCAGCCCTGTCCTTCCTCTCCA
TCATGATGGATTCACTTCCAGTTGAAATCCTTATGGTACCCTCCCTGGATTATGGCAGTAATCAGAGAGCTGGTCTCCT
TAACTCAGGATTCACTTCTTCTCATCTGTTGTTCACAGTGACATCAGAAAGATATTTTAAAATGATGAACTAGAATTAA
TTATATAAAACACACATACACACATAAATAATACTTAAATTTTTCAATGATGTTCCAATTATGTAAAATATAATATAGG
AGGCACTTTATGTTCTGGCCTCAATCTTTCAATTCAAACTTATCTCCTGCCACTATCTCCTTTGAACATTGTATTCCAG
CTACTTTAGAATAATAATAATACATAATATTCATAGAGCCCTTCCTGGGTTCCTATCACCGTACAAAATACTTCACATA
TAACATTTAATCTTTGACAACTTTATTAGGCATGCACAATTATTATCTATCTATATATCTATATCTATATATAAAAT
CTATATTTTATAGATAAGAAAATAGAGGGTAAAAACTTGCCAAAATTACAAAGCTTAGAAGTGTAGCAGTTGGGATTTG
AATCTAGGCATCCTGCCTCTATAGTCTACAGTGGCTTTCTTGTGCCAAAAGCCTTGCAGTTCCCTAGACTTAACATTTC
TCAAAATCTGTGTCTTTCACATGCTCTTCCAATTGTCTGGAAAATCTTTCCCAACCTCAGTCTAACTGTGGTACTCATG
TTCACCCCACAAGAATTGACTCCATCTGTCCCCTCTCCATGAAAATTTCTTTGAATCTCAGCACTTTGGGAGGCTGAGG
CAGGTG

SEQ ID:45
>STAR45
```

FIG. 26 (CONT)

CACGCCCCAGCGTGCCCTGGACTACTGCTCCGCAGGACTCCTGTTCTGCTGCACCCTGGACTACGGCACCAGAGGACCC
AGCTCCCGCCGGCCTGAGCTATGGCACCAGAGGACCCAGCTCCCGGCAGCCTGGACTATGGCACCAGAGGACCCAGCCC
CCCGCTTCCTGGGCTAAGGCACAGTAGGACCCTGCCTCATCGTGTACTCCTGCTCAGGAGGACCCTCGCAGGGCGGCGC
ACTGGACTAAGCTACTGAAGGAGCCCCACCCCTGCCTAACCCTGGACTAAGGCACTGGAGAACTCTTGCTCCGCAGAGC
CACGGACTCTTGCACAAGAGAACCTCAGCCCAGCCGTGCCCTGGACTGTGGCACAGTAGGGCCCACACCACGCCATGGA
CTCCTGTATTGGAGGAAGAGTAGTGATAAATGTCCAGGTTTACAACTTGAAAAGTAGCAATCAATGTGCCACAATAGAT
GGATGTGATGTAAAATTATAAATGATGAAAACATTATGTGTAATTGCCTAGCCAGAACAGTTACACAAGACAAAGACGT
AAAAGAAATCCACATAGGGAAGGAAGAGGTAAGATTGTTTCTGTTTTTTGAAAATATAATCTTAAGATAGAGAAAATCT
TAAAGATTCCACCAAAATAAATGGTTATAGCTGATGAAGAAATTCAATAAAGTTAATAGTTACAAAATCAACATACAAA
TATCATTATTGTTTCTATTAACTAATGACAAACTATTACCTGAAAAATAAAGGCAATTCAATTTATAATAGAATCAAAA
CAGATATATAAATATATAAAAGACAGGAGTAAATTTAATCAAAACCATAAAAGATTTACATACTGAAAACTATAGCACA
TTGATGAAAAAAATTAAAATGGCATAAATAAATGGAGAAACATCCTTCATTGATGGATTCAAAAATTAGTATTGTAAAA
GTGTCAATGCTACCCAAAGCAATCTACAGATTAAATGCAACCACTATCAAATTCCAATGTCATTCTTCACAGAAATAGA
AAAATTACTGCTAAAATTTGTATGGAACCACAAAAGACCTGGACCAACCAAAGCAATCTTGAACAAAAGAACAAAGCT
GGAGGCATCAGACTACCTGACTCCAAACTCTATTACAAAGCTATAGGAATTAAAACAGCATAGCAATGGCATAAAAACA
GACATGTAAAACAGTACAAAGGGATATAGAACCTGTAAATAAATCCGTGTGTCTGTGGTCAATTGATTTTTTGATAAAA
TAACTAAAAATACACAGTGAAGAAAGAAAATTATTTTCAATAAATGGTGTAGACAAAACTGACTATCCACATACAGAAG
AATAAAATTTGACTTTTATTTTGCTCTTTATACAAGCATCAAATCAAAATTAAAGTTTAAATGTAAAACTACTACAAGG
AAATATAGAAGGAGACTGTATGACATTGGCCTGAGCTATGATTTTCTGTAGATTATTCCAAAAGGCAACAAAAGCAAAA
CACACAAATGAGACTGCATAAAACTTAAAACTTTTCCACAGGAAAAGAAGCAATGATAGAATTAAGAGAACCCACAAAT
GGGATAATATTTTTAAACCATACATCAGGTAAGGGGCTCATATAATAATATATAAGCAACTCAACCTACTCAAAAATAA
GAAAAAAACTATGCTTATTAAAAAATAAGCAAAGAATCAGAATAGACATTTCCTACATCATACAAAAGGCCAACCAGGT
ACATGAAAAATCATAAACATTCCTAATTATCAGAGAAGTGCAAATCCACAATGAGATATCACCTCACACATTT
TACTAGGGCTATTATAAAAAAGATGGAAGATAAGTGTTGGTGAGGATGTGGAGAAAAAGAAACCCTGTACACTGTTGG
TAGGAATGGAAATTAGTACAGCCATCTTGGAAAACAGTACGAAGCTTTCTCAAGAAATTATAAATTTATTTACCCTATG
ATCCAT

SEQ ID:46
>STAR46
ATTGTTTTTCTCGCCCTTCTGCATTTTCTGCAAATTCTGTTGAATCATTGCAGTTACTTAGGTTTGCTTCGTCTCCCCC
ATTACAAACTACTTACTGGGTTTTTCAACCCTAGTTCCCTCATTTTTATGATTTATGCTCATTTCTTTGTACACTTCGT
CTTGCTCCATCTCCCAACTCATGGCCCCTGGCTTTGGATTATTGTTTGGTCTTTTATTTTTTGTCTTCTTCTACCTCA
ACACTTATCTTCCTCTCCCAGTCTCCGGTACCCTATCACCAAGGTTGTCATTAACCTTTCATATTATTCCTCATTATCC
ATGTATTCATTTGCAAATAAGCGTATATTAACAAATCACAGGTTTATGGAGATATAATTCACATACCTTAAAATTCAG
GCTTTTAAAGTGTACCTTTCATGTGGTTTTGGTATATTCACAAAGTTATGCATTGATCACCACCATCTGATTCCATAA
CATGTTCAATACCTCAAAAAGAAGTCTGTACTCATTAGTAGTCATTTCACATTCACCACTCCCTCTGGCTCTGGGCAGT
CACTGATCTTTGTGTCTCTATGGATTTGCCTAGTCTAGGTATTTTTATGTAAATGGCATCATACAACATGTGACCTTTT
GTTTGGCTTTTTTCATTTAGCAAATGTTATCAAGGTCTGTCCCTGTTGTAGCATGTATTAGCACTTCATTTCTTATAT
GCTGAATGATATACTTTATTTGTCCATCAGTTGTTCATGCTTTATTTGTCCATCAGTTGATGAACATTTGCGTTTTTGC
CACTTTGGGCTATTAAGAATAATGCTACTGTGAACAAGTGTGTACAAGTTCCTCTACAAATTTTTGTGTGGACATATCC
TTTCAGTTCTCTCAGGTGTATATCTGGGAATTGAATTGCTGGGTCGTGTAGTAGCTATGTTAAACACTTTGAGAAACTG
CTATAATGTTCTCCGAGCTGTACCATTTTAAATTCTGTCTATCGAGGATTCCACGTTCTCCACTTCCTCACCAGTGTAT
GGATTTGGGGTATACTTTTTAAAAAGTGGGATTAGGCTGGGCACAGTGGCTCACACCTGTAATCCCAACACTTCAGGA
AGCTGAGGTGGAGGATCACTTGAGCCTAGTAGTTTGAGACCAGCCTGGGCAACATAGGGAGACCCTGTCTCTACAAAA
AATAATTTAAAATAAATTAGCTGGGCGTTGTGGCACACACCTGTAGTCCCAGCTACATGGGAGGCTGAGGTGGAAGGAT
TCCCTGAGCCCAGAAGTTTGAGGTTGCAGTGAGCCATGATGGCAGCACTATACTGTAGCCTGGGTGTCAGAGCAAGACT
CCGTTTCAGGGAAGAAAAAAAAAAGTGGGATGATATTTTTGACACTTTTCTTCTTGTTTTCTTAATTTCATACTTCTGG
AAATTCCATTAAATTAGCTGGTACCACTCTAACTCATTGTGTTTCATGGCTGCATAGTAATATTGCATAATATAAATAT
ACCATTCATTCATCAAAGTTAGCAGATATTGACTGTTAGGTGCCAGGCACTGCTCTAAGCGTTAAAGAAAAACACACAA
AAACTTTTGCATTCTTAGAGTTTATTTTCCAATGGAGGGGTGGAGGGAGGTAAGAATTTAGGAAATAAATTAATTACA
TATATAGCATAGGGTTTCACCAGTGAGTGCAGCTTGAATCGTTGGCAGCTTTCTTAGTAGTATAAATACAGTACTAAAG
ATGAAATTACTCTAAATGGTGTTACTTAAATTACTGGAATAGGTATTACTATTAGTCACTTTGCAGGTGAAAGTGGAAA
CACCATCGTAAAATGTAAAATAGGAAACAGCTGGTTAATGTT

SEQ ID:47
>STAR47
ATCATTAGTCATTAGGGAAATGCAAATGAAAAACACAAGCAGCCACCAATATACACCTACTAGGATGATTTAAAGGAAA
ATAAGTGTGAAGAAGGACGTAAAGAAATTGTAACCCTGATACATTGATGGTAGAAATGGATAAAGTTGCAGCCACTGTG
AAAAACAGTCTGCAGTGGCTCAGAAGGTTAAATATAGAACCCCTGTTGGACCCAGGAACTCTACTCTTAGGCACCCCAA
AGAATAGAGAACAGAAATCAAACAGATGTTTGTATACTAATGTTTGTAGCATCACTTTTCACAGGAGCCAAAAGGTGGA
AATAATCCAACCATCGATGAACAAATGAATGTAATAAAAGCAAGGTGGTCTGCATGCAATGCTACATCATCCATCTGTA
AAAAACGAACATCATTTTGATAGATGATACAACATGGGTGGACATTGAGAACATTATGCTTAGTGAAATAAGCCAGACA
CAAAAGGAATATATTGTATAATTGTAATTACATGAAGTGCCTAGAATAGTCAAATTCATACAAGAGAAAGTGGGATAGG

FIG. 26 (CONT)

AATCACCATGGGCTGGAAATAGGGGGAAGGTGCTATACTGCTTATTGTGGACAAGGTTTCGTAAGAAATCATCAAAATT
GTGGGTGTAGATAGTGGTGTTGGTTATGCAACCCTGTGAATATATTGAATGCCATGGAGTGCACACTTTGGTTAAAAGG
TTCAAATGATAAATATTGTGTTATATATATTTCCCCACGATAGAAAACACGCACAGCCAAGCCCACATGCCAGTCTTGT
TAGCTGCCTTCCTTTACCTTCAAGAGTGGGCTGAAGCTTGTCCAATCTTTCAAGGTTGCTGAAGACTGTATGATGGAAG
TCATCTGCATTGGGAAAGAAATTAATGGAGAGAGGAGAAAACTTGAGAATCCACACTACTCACCCTGCAGGGCCAAGAA
CTCTGTCTCCCATGCTTTGCTGTCCTGTCTCAGTATTTCCTGTGACCACCTCCTTTTTCAACTGAAGACTTTGTACCTG
AAGGGGTTCCCAGGTTTTTCACCTCGGCCCTTGTCAGGACTGATCCTCTCAACTA

SEQ ID:48
>STAR48
ATCATGTATTTGTTTTCTGAATTAATTCTTAGATACATTAATGTTTTATGTTACCATGAATCTGATATTATAATATAAT
ATTTTTAATTGGTTGCTACTGTTTATAAGAATTTCATTTTCTGTTTACTTTGCCTTCATATCTGAAAACCTTGCTGATT
TGATTAGTGCATCCACAAATTTTCTTGGATTTTCTATGGGTAATTACAAATCTCCACACAATGAGGTTGCAGTGAGCCA
AGATCACACCACTGTACTCCAGCCTGGGCGACAGAGTGAGACACCATCTCACAAAAACACATAAACAAACAAACAGAAA
CTCCACACAATGACAACGTATGTGCTTTCTTTTTTTCTTCCTCTTTCTATAATATTTCTTTGTCCTATCTTAACTGAAC
TGGCCAGAAACCCCAGGACAATGATAAATACGAGCAGTGTCAACAGACATCTCATTCCCTTTCCTAGCTTTTATAAAAA
TAACGATTATGCTTCAACATTACATATGGTGGTGTCGATGGTTTTGTTATAGATAAGCTTATCAGGTTAAGAAATTTGT
CTGCGTTTCCTAGTTTGGTATAAAGATTTTAATATAAATGAATGTTGTATTTTATCATCTTATTTTTTCCTACATCTG
CTAAGGTAATCCTGTGTTTTCCCCTTTTCAATCTCCTAATGTGGTGAATGACATTAAAATACCTTCTATTGTTAAAATA
TTCTTGCAACGCTGTATAGAACCAATGCCTTTATTCTGTATTGCTGATGGATTTTTGAAAAATATGTAGGTGGACTTAG
TTTTCTAAGGGGAATAGAATTTCTAATATATTTAAAATATTTTGCATGTATGTTCTGAAGGACATTGGTGTGTCATTTC
TATACCATCTGGCTACTAGAGGAGCCGACTGAAAGTCACACTGCCGGAGGAGGGGAGAGGTGCTCTTCCGTTTCTGGTG
TCTGTAGCCATCTCCAGTGGTAGCTGCAGTGATAATAATGCTGCAGTGCCGACAGTTCTGGAAGGAGCAACAACAGTGA
TTTCAGCAGCAGCAGTATTGCGGGATCCCCACGATGGAGCAAGGGAAATAATTCTGGAAGCAATGACAATATCAGCTGT
GGCTATAGCAGCTGAGATGTGAGTTCTCACGGTGGCAGCTTCAAGGACAGTAGTGATGGTCCAATGGCGCCCAGACCTA
GAAATGCACATTTCCTCAGCACCGGCTCCAGATGCTGAGCTTGGACAGCTGACGCCT

SEQ ID:49
>STAR49
AAACCAGAAACCCAAAACAATGGGAGTGACATGCTAAAACCAGAAACCCAAAACAATGGGAGGGTCCTGCTAAACCAGA
AACCCAAAACAATGGGAGTGAAGTGCTAAAACCAGAAACCCAAAACAATGGGAGTGTCCTGCTACACCAGAAACCCAAA
ACGATGGGAGTGACGTGATAAAACCAGACACCCAAAACAATGGGAGTGACGTGCTAAACCAGAAACCCAAAACAATGGG
AGTGACGTGCTAAAACCTGGAAACCTAAAACAATGCGAGTGAGGTGCTAACACCAGAATCCATAACAATGTGAGTGACG
TGCTAAACCAGAACCCAAAACAATGGGAGTGACGTGCTAAAACAGGAACCCAAAACAATGAGAGTGACGTGCTAAACCA
GAAACCCAAAACAATGGGAATGACGTGCTAAAACCGGAACCCAAAACAATGGGAGTGATGTGCTAAACCAGAAACCCAA
AACAATGGGAATGACATGCTAAAACTGGAACCCAAAACAATGGTAACTAAGAGTGATGCTAAGGCCCTACATTTTGGTC
ACACTCTCAACTAAGTGAGAACTTGACTGAAAAGGAGGATTTTTTTTCTAAGACAGAGTTTTGGTCTGTCCCCCAGAG
TGGAGTGCAGTGGCATGATCTCGGCTCACTGCAAGCTCTGCCTCCCGGGTTCAGGCCATTCTCCTGCCTCAGCCTCCTG
AGTAGCTGGGAATACAGGCACCCGCCACCACACTTGGCTAATTTTTTGTATTTTTAGTAGAGATGGGGTTTCACCATAT
TAGCAAGGATGGTCTCAATCTCCTGACCTCGTGATCTGCCCACCTCAGGCTCCCAAAGTGCTGGGATTACAGGTGTGAG
CCACCACACCCAGCAAAAGGAGGAATTTTTAAAGCAAAATTATCGGAGGCCATTGTTTTGAACTAAGCTCATGCAATA
GGTCCCAACAGACCAAACCAAACCAAATGGAGTCACTCATGCTAAATGTAGCATAATCAAA

SEQ ID:50
>STAR50
CAACCATCGTTCCGCAAGAGCGGCTTGTTTATTAAACATGAAATGAGGGAAAAGCCTAGTAGCTCCATTGGATTGGGAA
GAATGGCAAAGAGAGACAGGCGTCATTTTCTAGAAAGCAATCTTCACACCTGTTGGTCCTCACCCATTGAATGTCCTCA
CCCAATCTCCAACACAGAAATGAGTGACTGTGTGTGCACATGCGTGTGCATGTGTGAAAGTATGAGTGTGAATGTGTCT
ATATGGGAACATATATGTGATTGTATGTGTGTAACTATGTGTGACTGCCAGCGTGGGGAGTGCTGGTTGGAGTGTGGTG
TGATGTGAGTATGCATGAGTGGCTGTGTGTATGACTGTGGCGGGAGGCGAAGGGGAGAAGCAGCAGGCTCAGGTGTCG
CCAGAGAGGCTGGGAGGAAACTATAAACCTGGGCAATTTCCTCCTCATCAGCGAGCCTTTCTTGGGCAATAGGGGCAGA
GCTCAAAGTTCACAGAGATAGTGCCTGGGAGGCATGAGGCAAGGCGGAAGTACTGCGAGGAGGGGCAGAGGGTCTGACA
CTTGAGGGGTTCTAATGGGAAAGGAAAGACCCACACTGAATTCCACTTAGCCCCAGACCCTGGGCCCAGCGGTGCCGGC
TTCCAACCATACCAACCATTTCCAAGTGTTGCCGGCAGAAGTTAACCTCTCTTAGCCTCAGTTTCCCCACCTGTAAAT
GGCAGAAGTAACCAAGCTTACCTTCCCGGCAGTGTGTGAGGATGAAAAGAGCTATGTACGTGATGCACTTAGAAGAAGG
TCTAGGGTGTGAGTGGTACTCGTCTGGTGGGTGTGGAGAAGACATTCTAGGCAATGAGGACTGGGGAGAGCCTGGCCCA
TGGCTTCCACTCAGCAAGGTCAGTCTCTTGTCCTCTGCACTCCCAGCCTTCCAGAGAGGACCTTCCCAACCAGCACTCC
CCACGCTGCCAGTCACACATAGTTACACACATACAATCACATATATGTTCCCATATAGACACATTCACACTCATACCTT
CACACATGCACACGCATGTGCACACACAGTCACTCATTTCTGTGTTGGAGATTGGGTGGGACATTCAATGGGTGAGGA
CCAACAGGTGTGAAGATTGCTTTCTAGAAAATGACTCCTGTCTCTTTGCCATTCTTCCCAATCCGATGGAGCTACTA
GGCTTTTCCCTCATTTCATGTTTAATAAACCTTCCCAATGGCGAAATGGGCTTTCTCAAGAAGTGGTGAGTGTCCCATC
CCTGCGGTGGGGACAGGGGTGGCAGCGGACAAGCCTGCCTGGAGGGAACTGTCAGGCTGATTCCCAGTCCAACTCCAGC
TTCCAACACCTCATCCTCCAGGCAGTCTTCATTCTTGGCTCTAATTTCGCTCTTGTTTTCTTTTTTATTTTTATCGAGA

FIG. 26 (CONT)

ACTGGGTGGAGAGCTTTTGGTGTCATTGGGGATTGCTTTGAAACCCTTCTCTGCCTCACACTGGGAGCTGGCTTGAGTC
AACTGGTCTCCATGGAATTTCTTTTTTTAGTGTGTAAACAGCTAAGTTTTAGGCAGCTGTTGTGCCGTCCAGGGTGGAA
AGCAGCCTGTTGATGTGGAACTGCTTGGCTCAGATTTCTTGGGCAAACAGATGCCGTGTCTCCAACTCACCAATTAAG
AAGCCCAGAAAATGTGGCTTGGAGACCACATGTCTGGTTATGTCTAGTAATTCAGATGGCTTCACCTGGGAAGCCCTTT
CTGAATGTCAAAGCCATGAGATAAAGGACATATATATAGTAGCTAGGGTGGTCCACTTCTTAGGGGCCATCTCCGGAGG
TGGTGAGCACTAAGTGCCAGGAAGAGAGGAAACTCTGTTTTGGAGCCAAAGCATAAAAAAACCTTAGCCACAAACCACT
GAACATTTGTTTTGTGCAGGTTCTGAGTCCAGGGAGGGCTTCTGAGGAGAGGGGCAGCTGGAGCTGGTAGGAGTTATGT
GAGATGGAGCAAGGGCCCTTTAAGAGGTGGGAGCAGCATGAGCAAAGGCAGAGAGGTGGTAATGTATAAGGTATGTCAT
GGGAAAGAGTTTGGCTGGAACAGAGTTTACAGAATAGAAAAATTCAACACTATTAATTGAGCCTCTACTACGTGCTCGA
CATTGTTCTAGTCACTGAGATAGGTTTGGTATACAAAACAAAATCCATCCTCTATGGACATTTTAGTGACTAACAACAA
TATAAATAATAAAAGTGAACAAAAGCTCAAAACATGCCAGGCACTATTATTTATTTATTTATTTATTTATTTATT
TTTTGAAACAGAGTCTCGCTCTGTTGCCCAGGCTGGAGTGTAGTGGTGCGATCTCGGCTCACTG

SEQ ID:51
>STAR51
TCACAGGTGACACCAATCCCCTGACCACGCTTTGAGAAGCACTGTACTAGATTGACTTTCTAATGTCAGTCTTCATTTT
CTAGCTCTGTTACAGCCATGGTCTCCATATTATCTAGTACAACACACATACAAATATGTGTGATACAGTATGAATATAA
TATAAAAATATGTGTTATAATATAAATATAATATTAAAATATGTCTTTATACTAGATAATAATACTTAATAACGTTGAG
TGTTTAACTGCTCTAAGCACTTTACCTGCAGGAAACAGTTTTTTTTTTATTTTGGTGAAATACAACTAACATAAATTTA
TTTACAATTTTAAGCATTTTTAAGTGTATAGTTTAGTGGAGTTAATATATTCAAAATGTTGTGCAGCCGTCACCATCAT
CAGTCTTCATAACTCTTTTCATATTGTAAAATTAAAAGTTTATGCTCATTTAAAAATGACTCCCAATTTCCCCCCTCCT
CAACCTCTGGAAACTACCATTCTATTTTCTGCCTCCGTAGTTTTGCCCACTCTAAGTACCTCACATAAGTGGAATTTGT
CTTATTTGCCTGTTTGTGACCGGCTGATTTCATTTAGTATAATGTCCTCAAGTTTTATTCACGTTATATAGCATATGTC
ATAATTTTCTTCACTTTTAAGCTTGAGTAATATTTCATCGTATGTATCTCACATTTTGCTTATCCATTCATCTCTCAGT
GGACACTTGAGTTGCTTCTACATTTTAGCTGTTGTGAATACTGCTGCTATGAACATGGGTGTATAAATATCTCAAGACC
TTTTTATCAGTTTTTTAAAATATATACTCAGTAGTAGTTTAGCTGGATTATATGGTAATTTTATTTTTAATTTTTGAGG
AACTGTCCTACCCTTTTATTCAATAGTAGCTATACCAATTGACAATTGGCATTCCTACCAACAGGGCATAAGGGTTCTC
AATTCTCCACATATTCCCTGATACTTGTTATTTTCAGGTGTTTTTTTTTTTTTTTTTTATGGGAGCCATGTTAAT
GGGTGTAAGGTGATATTTCATTATAGTTTTGATTTGCATTTCCCTAATGATTAGTGATGTTAAGCATCTCTTCATGTGC
CTATTGGCCATTTGTATATCTTCTTTAAAAATATATATATACTCATTCCTTTGCCCATTTTTGAATTATGTTTATTTTT
TGTTATTGAGTTTCAATACTTTTCTATATAACCTAGGTATTAATCCTTTATCAGACTTAAGATTTGCAAATATTCTCTT
TCATTCCACAGGTTGCTAATTCTCTCTGTTGGTAATATCTTTTGATGCTGTTGTGTCCAGAATTGATTCATTCCTGTGG
GTTCTTGGTCTCACTGACTTCAAGAATAAAGCTGCGGACCCTAGTGGTGAGTGTTACACTTCTTATAGATGGTGTTTCC
GGAGTTTGTTCCTTCAGATGTGTCCAGAGTTTCTTCCTTCCAATGGGTTCATGGTCTTGCTGACTTCAGGAATGAAGCC
GCAGACCTTCGCAGTGAGGTTTACAGCTCTTAAAGGTGGCGTGTCCAGAGTTGTTTGTTCCCCTGGTGGGTTCGTGGT
CTTGCTGACTTCAGGAATGAAGCCGCAGACCCTCGCAGTGAGTGTTACAGCTCATAAAGGTAGTGCGGACACAGAGTGA
GCTCCAGCAACATTTACTGTGAAGAGCAAAAGAACAAAGCTTCCACAGCATAGAAGGACACCCCAGCGGGTTCCTGCTG
CTGGCTCAGGTGGCCAGTTATTATTCCCTTATTTGCCCTGCCCACATCCTGCTGATTGGTCCATTTTACAGAGTACTGA
TTGGTCCATTTTACAGAGTGCTGATTGGTGCATTTACAATCCTTTAGCTAGACACAGAGTGCTGATTGCTGCATTCTTA
CAGAGTGCTGATTGGTGCATTTACAGTCCTTTAGCTAGATACAGAACGCTGATTGCTGCGTTTTTTACAGAGTGCTGAT
TGGTGCATTTACAATCCTTTAGCTAGACACAGTGCTGATTGGTGGGTTTTACAGAGTGCTGATTGGTGCGTCTTTACA
GAGTGCTGATTGGTGCATTTACAATCCTTTAGCTAGACACAGAGTGCTGATTGGTGCGTTTATAATCCTCTAGCTAGAC
AGAAAAGTTTTCCAAGTCCCCACCTGACCGAGAAGCCCCACTGGCTTCACCTCTCACTGTTATACTTTGGACATTTGTC
CCCCCAAAATCTCATGTTGAAATGTAACCCCTAATGTTGGAACTGAGGCCAGACTGGATGTGGCTGGGCCATGGGGA

SEQ ID:52
>STAR52
CTTATGCCATCTGGCGGTGCCATGTGGAACTTCGCTGAAGAAGCTAAATTTACTGACCATCTGTGCCTAGAGCGGGTTT
CTCCAAGGAAAGGCTCTGTAAATCTCGTCCTTTTGAAATCTAGGGGAAAACAGCCTCCTTCACTGAGGATTAATTTAAA
GAAAGGGGGAAATAGGAAAATTCCATGCGTTGGAAGTCCATTTAGATTTCTACATGAACCATCATATATGTGCACTACA
TAATTCTTATTTTTTTATTTTTAAAAAAGGGATAATTTATATTCCAGTGACAAGTTTGGGAAAGGCCAAGGCAAGCAAT
TGAGTTGAACATTATGTAGCGTTTATATAGACCTTGCAGACGTCTGTGCAATATCCACCACTGAACACGTGAGGTCGTA
CTCAAGTCTCTCTGGCCCCTGGTAATGTGACTCCCTTCCTTTATTTGCATGAATCGCCTGGATTGGGTGTCAGGTTTTT
AAAACGTCAAGGTTTACGCCTATTGTTGTCAACCAATCAGCATCCTACTTTGACGTGATTGGCTTCTACTGTAGGTGTC
AATCATCCAAAATTTGCATACTACTCCTCAGGCCGCCGGGAGCCTGTCAGTCGGCTGTGGCAGCTGGAAGAGAAGGAAT
CGGACGGAGAAGAATGAAAAATCACTTTGCTTTCGCAAAGCGAAAGAAAAGTATTCTTTTCCTCATTATTTTTAAATAA
ATTTGATTGTATATTTACCTAATAAAATAAACATTCAATTAAACAAAAATAAGCAACTATCAAAGATTTGTTTACTAAT
TTTCGTAATGTTTACTGTTTCAATAAGTAGCCAAAGGAATATTAAAACACAAAAATATGAATGCTGATAATTTTATGTC
ATAAAGACCATTTTAAAACTAAAAGTGAACATGGGGTTTCTAAATAAAATTACCGTGGTAGCGTAAAAACACTGCTTTC
AATACTTGGGCATGCTGAAAGTGCTGCATCCTAAGATAAAAAATACACCAAGGGGGGGATTTCAAAGAACATTATTTTG
CTTTTAATAATCCTGTATTTCTGTCACTTTGCCCTTTTTATTTATTTACCGTGAACTCACAGACAGAATATTACTTGGA
GTTTCTGAAATACTTGTGTTTGTACATTTCTCATCTTACACGTACCCACACACCCCAAAATAAAAAAACAAAGAAGAG

FIG. 26 (CONT)

SEQ ID:53
>STAR53
CCCTGAGGAAGATGACGAGTAACTCCGTAAGAGAACCTTCCACTCATCCCCCACATCCCTGCAGACGTGCTATTCTGTT
ATGATACTGGTATCCCATCTGTCACTTGCTCCCCAAATCATTCCCTTCTTACAATTTTCTACTGTACAGCATTGAGGCT
GAACGATGAGAGATTTCCCATGCTCTTTCTACTCCCTGCCCTGTATATATCCGGGGATCCTCCCTACCCAGGATGCTGT
GGGGTCCCAAACCCCAAGTAAGCCCTGATATGCGGGCCACACCTTTCTCTAGCCTAGGAATTGATAACCCAGGCGAGGA
AGTCACTGTGGCATGAACAGATGGTTCACTTCGAGGAACCGTGGAAGGCGTGTGCAGGTCCTGAGATAGGGCAGAATCG
GAGTGTGCAGGGTCTGCAGGTCAGGAGGAGTTGAGATTGCGTTGCCACGTGGTGGGAACTCACTGCCACTTATTTCCTT
CTCTCTTCTTGCCTCAGCCTCAGGGATACGACACATGCCCATGATGAGAAGCAGAACGTGGTGACCTTTCACGAACATG
GGCATGGCTGCGGACCCCTCGTCATCAGGTGCATAGCAAGTGAAAGCAAGTGTTCACAACAGTGAAAAGTTGAGCGTCA
TTTTTCTTAGTGTGCCAAGAGTTCGATGTTAGCGTTTACGTTGTATTTTCTTACACTGTGTCATTCTGTTAGATACTAA
CATTTTCATTGATGAGCAAGACATACTTAATGCATATTTTGGTTTGTGTATCCATGCACCTACCTTAGAAAACAAGTAT
TGTCGGTTACCTCTGCATGGAACAGCATTACCCTCCTCTCTCCCCAGATGTGACTACTGAGGGCAGTTCTGAGTGTTTA
ATTTCAGATTTTTTCCTCTGCATTTACACACACACGCACACAAACCACACCACACACACACACACACACACACACACAC
ACACACACACACACACACCAAGTACCAGTATAAGCATCTGCCATCTGCTTTTCCCATTGCCATGCGTCCTGGTCAAGCT
CCCCTCACTCTGTTTCCTGGTCAGCATGTACTCCCCTCATCCGATTCCCCTGTAGCAGTCACTGACAGTTAATAAACCT
TTGCAAACGTTCCCCAGTTGTTTGCTCGTGCCATTATTGTGCACACAGCTCTGTGCACGTGTGTGCATATTTCTTTAGG
AAAGATTCTTAGAAGTGGAATTGCTGTGTCAAAGGAGTCATTTATTCAACAAAACACTAATGAGTGCGTCCTCGTGCTG
AGCGCTGTTCTAGGTGCTGGAGCGACGTCAGGGAACAAGGCAGACAGGAGTTCCTGACCCCCGTTCTAGAGGAGGATGT
TTCCAGTTGTTGGGTTTTGTTTGTTTGTTTCTTCTAGAGATGGTGGTCTTGCTCTGTCCAGGCTAGAGTGCAGTGGCAT
GATCATAGC

SEQ ID:54
>STAR54
CCATAAAAGTGTTTCTAAACTGCACAAAAATCCCCCTACAGTCTTACAGTTCAAGAATTTTCAGCATGAAATGCCTGGT
AGATTACCTGACTTTTTTTGCCAAAAATAAGGCACAGCAGCTCTCTCCTGACTCTGACTTTCTATAGTCCTTACTGAAT
TATAGTCCTTACTGAATTCATTCTTCAGTGTTGCAGTCTGAAGGACACCCACATTTTCTCTTTGTCTTTGTCAATTCTT
TGTGTTGTAAGGGCAGGATGTTTAAAAGTTGAAGTCATTGACTTGCAAAATGAGAAATTTCAGAGGGCATTTTGTTCTC
TAGACCATGTAGCTTAGAGCAGTGTTCACACTGAGGTTGCTGCTAATGTTTCTGCAGTTCTTACCAATAGTATCATTTA
CCCAGCAACAGGATATGATAGAGGACTTCGAAAACCCCAGAAAATGTTTTGCCATATATCCAAAGCCCTTTGGGAAATG
GAAAGGAATTGCGGGCTCCCATTTTTATATATGGATAGATAGAGACCAAGAAAGACCAAGGCAACTCCATGTGCTTTAC
ATTAATAAAGTACAAAATGTTAACATGTAGGAAGTCTAGGCGAAGTTTATGTGAGAATTCTTTACACTAATTTTGCAAC
ATTTTAATGCAAGTCTGAAATTATGTCAAAATAAGTAAAAATTTTTACAAGTTAAGCAGAGAATAACAATGATTAGTCA
GAGAAATAAGTAGCAAAATCTTCTTCTCAGTATTGACTTGGTTGCTTTTCAATCTCTGAGGACACAGCAGTCTTCGCTT
CCAAATCCACAAGTCACATCAGTGAGGAGACTCAGCTGAGACTTTGGCTAATGTTGGGGGGTCCCTCCTGTGTCTCCCC
AGGCGCAGTGAGCCTGCAGGCCGACCTCACTCGTGGCACACAACTAAATCTGGGGAGAAGCAACCCGATGCCAGCATGA
TGCAGATATCTCAGGGTATGATCGGCC

SEQ ID:55
>STAR55
CCTGAACTCATGATCCGCCCACCTCAGCCTCCTGAAGTGCTGGGATTACAGGTGTGAGCCACCACACCCAGCCGCAACA
CACTCTTGAGCAACCAATGTGTCATAAAAGAAATAAAATGGAAATCAGAAAGTATCTTGAGACAGACAAAAATCGAAAC
ACAACATACCAAAATTTATGGGACACAGCAAAAGCAGTTTTAGGAGGGAAGTTTATAGTGATGAATACCTACCTCAAAA
TCATTAGCCTGATTGGATGACACTACACTGTATAAATGAATTGAAAACCACATTGTGCCCCATACATATATACAATTTT
TATTTGTTAATTAAAAATAAAATAAAACTTTAAAAAAGAAGAAGAGCTCAAATAAACAACCTAACTTTATACCTCAAG
GAAATAGAAGAGCCAGCTAAGCCCAAAGTTGACAGAAGGAAAAAAATATTGGCAGAAAGAAATGAAACAGAGACTAGAA
AGACAATTGAAGAGATCAGCAAAACTA

SEQ ID:56
>STAR56
ACACAGGAAAAGATCGCAATTGTTCAGCAGAGCTTTGAACCGGGGATGACGGTCTCCCTCGTTGCCCGGCAACATGGTG
TAGCAGCCAGCCAGTTATTTCTCTGGCGTAAGCAATACCAGGAAGGAAGTCTTACTGCTGTCGCCGCCGGAGAACAGGT
TGTTCCTGCCTCTGAACTTGCTGCCGCCATGAAGCAGATTAAAGAACTCCAGCGCCTGCTCGGCAAGAAAACGATGGAA
AATGAACTCCTCAAAGAAGCCGTTGAATATGGACGGGCAAAAAAGTGGATAGCGCACGCGCCCTTATTGCCCGGGGATG
GGGAGTAAGCTTAGTCAGCCGTTGTCTCCGGGTGTCGCGTGCGCAGTTGCACGTCATTCTCAGACGAACCGATGACTGG
ATGGATGGCCGCCGCAGTCGTCACACTGATGATACGGATGTGCTTCTCCGTATACACCATGTTATCGGAGAGCTGCCAA
CGTATGGTTATCGTCGGGTATGGGCGCTGCTTCGCAGACAGGCAGAACTTGATGGTATGCCTGCGATCAATGCCAAACG
TGTTTACCGGATCATGCGCCAGAATGCGCTGTTGCTTGAGCGAAAACCTGCTGTACCGCCATCGAAACGGGCACATACA
GGCAGAGTGGCCGTGAAAGAAAGCAATCAGCGATGGTGCTCTGACGGGTTCGAGTTCTGCTGTGATAACGGAGAGAGAC
TGCGTGTCACGTTCGCGCTGGACTGCTGTG

SEQ ID:57
>STAR57

FIG. 26 (CONT)

TCCTTCTGTAAATAGGCAAAATGTATTTTAGTTTCCACCACACATGTTCTTTTCTGTAGGGCTTGTATGTTGGAAATTT
TATCCAATTATTCAATTAACACTATACCAACAATCTGCTAATTCTGGACATCTGGCACTGAATAAAAAAGTTATAGTTT
CTGATTTTGTGGAGCTTGGACTTTAATGATGGACAAAACAACACATTCTTAAATATATATTTCATCAAAATTATAGTGG
GTGAATTATTTATATGTGCATTTACATGTGTATGTATACATAAATGGGCGGTTACTGGCTGCACTGAGAATGTACACGT
GGCGCGAACGAGGCTGGGCGGTCAGAGAAGGCCTCCCAAGGAGGTGGCTTTGAAGCTGAGTGGTGCTTCCACGTGAAAA
GGCTGGAAAGGGCATTCCAAGAAAAGGCTGAGGCCAGCGGGAAAGAGGTTCCAGTGCGCTCTGGGAACGGAAAGCGCAC
CTGCCTGAAACGAAAATGAGTGTGCTGAAATAGGACGCTAGAAAGGGAGGCAGAGGCTGGCAAAAGCGACCGAGGAGGA
GCTCAAAGGAGCGAGCGGGGAAGGCCGCTGTGGAGCCTGGAGGAAGCACTTCGGAAGCGCTTCTGAGCGGGTAAGGCCG
CTGGGAGCATGAACTGCTGAGCAGGTGTGTCCAGAATTCGTGGGTTCTTGGTCTCACTGACTTCAAGAATGAAGAGGGA
CCGCGGACCCTCGCGGTGAGTGTTACAGCTCTTAAGGTGGCGCGTCTGGAGTTTGTTCCTTCTGATGTTCGGATGTGTT
CAGAGTTTCTTCCTTCTGGTGGGTTCGTGGTCTCGCTGGCTCAGGAGTGAAGCTGCAGACCTTCGCGGTGAGTGTTACA
GCTCATAAAAGCAGGGTGGACTCAAAGAGTGAGCAGCAGCAAGATTTATTGCAAAGAATGAAAGAACAAAGCTTCCACA
CTGTGGAAGGGGACCCCAGCGGGTTGCCACTGCTGGCTCCCGCAGCCTGCTTTTATTCTCTTATCTGGCCCCACCCACAT
CCTGCTGATTGGTAGAGCCGAATGGTCTGTTTTGACGGCCCTGATTGGTGCGTTTACAATCCCTGCGCTAGATACAAAG
GTTCTCCACGTCCCCACCAGATTAGCTAGATAGAGTCTCCACACAAAGGTTCTCCAAGGCCCCACCAGAGTAGCTAGAT
ACAGAGTGTTGATTGGTGCATTCACAAACCCTGAGCTAGACACAGGGTGATGACTGGTGTGTTTACAAACCTTGCGGTA
GATACAGAGTATCAATTGGCGTATTTACAATCACTGAGCTAGGCATAAAGGTTCTCCAGGTCCCCACCAGACTCAGGAG
CCCAGCTGGCTTCACCCAGTGG

SEQ ID:58
>STAR58
AAGTTTACCTTACCCCTAAATTATTTCATTGTGATTGGCATTTTAGGAAATATGTATTAAGGAATGTCTCTTAGGAGAT
AAGGATAACATATGTCTAAGAAAATTATATTGAAATATTATTACATGAACTAAAATGTTAGAACTGAAAAAAAATTATT
GTAACTCCTTCCAGCGTAGGCAGGAGTATCTAGATACCAACTTTAACAACTCAACTTTAACAACTTCGAACCAACCAGA
TGGCTAGGAGATTCACCTATTTAGCATGATATCTTTTATTGATAAAAAAATATAAAACTTCCATTAAATTTTTAAGCTA
CTACAATCCTATTAAATTTTAACTTACCAGTGTTCTCAATGCTACATAATTTAAAATCATTGAAATCTTCTGATTTTAA
CTCCTCAGTCTTGAAATCTACTTATTTTTAGTTACATATATATCCAATCTACTGCCGCTAGTAGAAGAAGCTTGGAATT
TGAGAAAAAAATCAGACGTTTTGTATATTCTCATATTCACTAATTTATTTTTTTAAATGAGTTTCTGCAATGCATCAAGC
AGTGGCAAAACAGGAGAAAAATTAAAATTGGTTGAAAAGATATGTGTGCCAAACAATCCCTTGAAATTTGATGAAGTGA
CTAATCCTGAGTTATTGTTTCAAATGTGTACCTGTTTATACAAGCGTATCACCTTTGAAATCTCAACATTAAATGAAAT
TTTATAAGCAATTTGTTGTAACATGATTATTATAAAATTCTGATATAACATTTTTTATTACCTGTTTAGAGTTTAAAGA
GAGAAAAGGAGTTAAGAATAATTACATTTTCATTAGCATTGTCCGGGTGCAAAAACTTCTAACACTATCTTCAAATCTT
TTTCTCCATTGCCTTCTGAACATACCCACTTGGGTATCTCATTAGCACTGCAAATTCAACATTTTCCATTGCTAATTTT
TCTCCCTAAATATTTATTTCTTTTCTCAGCTTTAGCCAATGTTTCACTATTGACCATTTGCTCAAGTATAGTGACGCTT
CAATGACCTTCAGAGAGCTGTTTCAGTCCTTCCTGGACTACTTGCATGCTTCCAACAAAATGAAGCACTCTTGATGTCA
GTCACTCAAATAAATGGAAATGGGCCCATTTACTAGGAATGTTAACAGAATAAAAAGATAGACGTGACACCAGTTGCTT
CAGTCCATCTCCATTTACTTGCTTAAGGCCTGGCCATATTTCTCACAGTTGATATGGCGCAGGGCACATGTTTAAATGG
CTCTTCTTGTAGGATGGTTTGACTGTTGGATTCCTCATCTTCCCTCTCCTTAGGAAGGAAGGTTACAGTAGTACTGTTG
GCTCCTGGAATATAGATTCATAAAGAACTAATGGAGTATCATCTCCCACTGCTCTTGT

SEQ ID:59
>STAR59
GAGATCACGCCACTGCACTCCAGCCTGGGGGACAGAGCAAGACTCCATCTCAGAAACAAACAAACACACAAAGCCAGTC
AAGGTGTTTAATTCGACGGTGTCAGGCTCAGGTCTCTTGACAGGATACATCCAGCACCCGGGGGAAACGTCGATGGGTG
GGGTGGAATCTATTTTGTGGCCTCAAGGGAGGGTTTGAGAGGTAGTCCCGCAAGCGGTGATGGCCTAAGGAAGCCCCTC
CGCCCAAGAAGCGATATTCATTTCTAGCCTGTAGCCACCCAAGAGGGAGAATCGGGCTCGCCACAGACCCCACAACCCC
CAACCCACCCCACCCCCACCCCTCCCACCCTCGTGAAATGGGCTCTCGCTCCGTCAGGCTCTAGTCACACCGTCGGTTT
TGGAACCTCCACCGTGTGTGCGTGGGTTGCGTGGTGGGGTGGGGCCGGCTGTGGACAGAGGAGGGGATAAAGCGGCGGT
GTCCCGCGGGTGCCCGGGACGTGGGGCGTGGGGCGTGGGTGGGGTGGCCAGAGCCTTGGGAACTCGTCGCCTGTCGGGA
CGTCTCCCCTCCTGGTCCCCTCTCTGACCTACGCTCCACATCTTCGCCGTTCAGTGGGGACCTTGTGGGTGGAAGTCAC
CATCCCTTTGGACTTTAGCCGACGAAGGCCGGGCTCCCAAGAGTCTCCCCGGAGGCGGGGCCTTGGGCAGGCTCACAAG
GATGCTGACGGTGACGGTTGGTGACGGTGATGTACTTCGGAGGCCTCGGGCCAATGCAGAGGTATCCATTTGACCTCGG
TGGGACAGGTCAGCTTTGCGGAGTCCCGTGCGTCCTTCCAGAGACTCATCCAGCGCTAGCAAGCATGGTCCCGAGG

SEQ ID:60
>STAR60
AGCAGTGCAGAACTGGGGAAGAAGAAGAGTCCCTACACCACTTAATACTCAAAAGTACTCGCAAAAAATAACACCCCTC
ACCAGGTGGCATNATTACTCTCCTTCATTGAGAAAATTAGGAAACTGGACTTCGTAGAAGCTAATTGCTTTATCCAGAG
CCACCTGCATACAAACCTGCAGCGCCACCTGCATACAAACCTGTCAGCCGACCCCAAAGCCCTCAGTCGCACCAAGCCT
CTCCTGCACACCCTCGTGCCTTCACACTGGCCGTTCCCCAAGCCTGGGGCATACTNCCCAGCTCTGAGAAATGTATTCA
TCCTTCAAAGCCCTGCTCATGTGTCCTNNTCAACAGGAAAATCTCCCATGAGATGCTCTGCTATCCCCATCTCTCCTGC
CCCATAGCTTAGGCANACTTCTGTGGTGGTGAGTCCTGGGCTGTGCTGTGATGTGTTCGCCTGCNATGNTGTTCTTCC
CCACAATGATGGGCCCCTGAATTCTCTATCTCTAGCACCTGTGCTCAGTAAAGGCTTGGGAAACCAGGCTCAAAGCCTG

FIG. 26 (CONT)

```
GCCCAGATGCCACCTTTTCCAGGGTGCTTCCGGGGGCCACCAACCAGAGTGCAGCCTTCTCCTCCACCAGGAACTCTTG
CAGCCCCACCCCTGAGCACCTGCACCCCATTACCCATCTTTGTTTCTCCGTGTGATCGTATTATTACAGAATTATATAC
TGTATTCTTAATACAGTATATAATTGTATAATTATTCTTAATACAGTATATAATTATACAAATACAAAATATGTGTTAA
TGGACCGTTTATGTTACTGGTAAAGCTTTAAGTCAACAGTGGGACATTAGTTAGGTTTTTGGCGAAGTCAAAAGTTATA
TGTGCATTTTCAACTTCTTGAGGGGTCGGTACNTCTNACCCCCATGTTGTTCAANGGTCAACTGTCTACACATATCATA
GCTAATTCACTACAGAAATGTTAGCTTGTGTCACTAGTATCTCCCCTTCTCATAAGCTTAATACACATACCTTGAGAGA
GCTCTTGGCCATCTCTACTAATGACTGAAGTTTTTATTTATTATAGATGTCATAATAGGCATAAAACTACATTACATCA
TTCGAGTGCCAATTTTGCCACCTTGACCCTCTTTTGCAAAACACCAACGTCAGTACACATATGAAGAGGAAACTGCCCG
AGAACTGAAGTTCCTGAGACCAGGAGCTGCAGGCGTTAGATAGAATATGGTGACGAGAGTTACGAGGATGACGAGAGTA
AATACTTCATACTCAGTACGTGCCAAGCACTGCTATAAGCGCTCTGTATGTGTGAAGTCATTTAATCCTCACAGCATCC
CACGGTGTAATTATTTTCATTATCCCCATGAGGGAACAGAAACTCAGAACGGTTCAACACATATGCGAGAAGTCGCAGC
CGGTCAGTGAGAGAGCAGGTTCCCGTCCAAGCAGTCAGACCCCGAGTGCACACTCTCGACCCCTGTCCAGCAGACTCAC
TCGTCATAAGGCGGGGAGTGNTCTGTTTCAGCCAGATGCTTTATGCATCTCAGAGTACCCAAACCATGAAAGAATGAGG
CAGTATTCANGAGCAGATGGNGCTGGGCAGTAAGGCTGGGCTTCAGAATAGCTGGAAAGCTCAAGTNATGGGACCTGCA
AGAAAAATCCATTGTTTNGATAAATAGCCAAAGTCCCTAGGCTGTAAGGGAAGGTGTGCCAGGTGCAAGTGGAGCTCT
AATGTAAAATCGCACCTGAGTCTCCTGGTCTTATGAGTNCTGGGTGTACCCCAGTGAAAGGTCCTGCTGCCACCAAGTG
GGCCATGGTTCAGCTGTGTAAGTGCTGAGCGGCAGCCGGACCGCTTCCTCTAACTTCACCTCCAAAGGCACAGTGCACC
TGGTTCCTCCAGCACTCAGCTGCGAGGCCCCTAGCCAGGGTCCCGGCCCCGGCAGCTGCTCCAGCTTCCTT
CCCCACAGCATTCAGGATGGTCTGCGTTCATGTAGACCTTTGTTTTCAGTCTGTGCTCCGAGGTCACTGGCAGCACTAG
CCCCGGCTCCTGT

SEQ ID:61
>STAR61
CAGCCCCCACATGCCCAGCCCTGTGCTCAGCTCTGCAGCGGGGCATGGTGGGCAGAGACACAGACGCCAAGGCCCTGCT
TCGGGGACGGTGGGCCTGGGATGAGCATGGCCTTGGCCTTCGCCGAGAGTNCTCTTGTGAAGGAGGGGTCAGGAGGGGC
TGCTGCAGCTGGGGAGGAGGGCGATGGCACTGTGGCANGAAGTGAANTAGTGTGGGTGCCTNGCACCCCAGGCACGGCC
AGCCTGGGGTATGGACCCGGGGCCNTCTGTTCTAGAGCAGGAAGGTATGGTGAGGACCTCAAAAGGACAGCCACTGGAG
AGCTCCAGGCAGAGGNACTTGAGAGGCCCTGGGGCCATCCTGTCTCTTTTCTGGGTCTGTGTGCTCTGGGCCTGGGCCC
TTCCTCTGCTCCCCGGGCTTGGAGAGGGCTGGCCTTGCCTCGTGCAAAGGACCACTCTAGACTGGTACCAAGTCTGGC
CCATGGCCTCCTGTGGGTGCAGGCCTGTGCGGGTGACCTGAGAGCCAGGGCTGGCAGGTCAGAGTCAGGAGAGGGATGG
CAGTGGATGCCCTGTGCAGGATCTGCCTAATCATGGTGAGGCTGGAGGAATCCAAAGTGGGCATGCACTCTGCACTCAT
TTCTTTATTCATGTGTGCCCATCCCAACAAGCAGGGAGCCTGGCCAGGAGGGCCCCTGGGAGAAGGCACTGATGGGCTG
TGTTCCATTTAGGAAGGATGGACGGTTGTGAGACGGGTAAGTCAGAACGGGCTGCCCACCTCGGCCGAGAGGGCCCCGT
GGTGGGTTGGCACCATCTGGGCCTGGAGAGCTGCTCAGGAGGCTCTCTAGGGCTGGGTGACCAGGNCTGGGGTACAGTA
GCCATGGGAGCAGGTGCTTACCTGGGGCTGTCCCTGAGCAGGGGCTGCATTGGGTGCTCTGTGAGCACACACTTCTCTA
TTCACCTGAGTCCCNCTGAGTGATGAGNACACCCTTGTTTTGCAGATGAATCTGAGCATGGAGATGTTAAGTGGCTTGC
CTGAGCCACACAGCAGATGGATGGTGTAGCTGGGACCTGAGGGCAGGCAGTCCCAGCCCGAGGACTTCCCAAGGTTGTG
GCAAACTCTGACAGCATGACCCCAGGGAACACCCATCTCAGCTCTGGTCAGACACTGCGGAGTTGTGTTGTAACCCACA
CAGCTGGAGACAGCCACCCTAGCCCCACCCTTATCCTCTCCCAAAGGAACCTGCCCTTTCCCTTCATTTTCCTCTTACT
GCATTGAGGGACCACACAGTGTGGCAGAAGGAACATGGGTTCAGGACCCAGATGGACTTGCTTCACAGTGCAGCCCTCC
TGTCCTCTTGCAGAGTGCGTCTTCCACTGTGAAGTTGGGACAGTCACACCAACTCAATACTGCTGGGCCCGTCACACGG
TGGGCAGGCAACGGATGGCAGTCACTGGCTGTGGGTCTGCAGAGGTGG

SEQ ID:62
>STAR62
AGTGTCAAATAGATCTACACAAAACAAGATAATGTCTGCCCATTTTTCCAAAGATAATGTGGTGAAGTGGGTAGAGAGA
AATGCATCCATTCTCCCCACCCAACCTCTGCTAAATTGTCCATGTCACAGTACTGAGACCAGGGGCTTATTCCCAGCG
GGCAGAATGTGCACCAAGCACCTCTTGTCTCAATTTGCAGTCTAGGCCCTGCTATTTGATGGTGTGAAGGCTTGCACCT
GGCATGGAAGGTCCGTTTTGTACTTCTTGCTTTAGCAGTTCAAAGAGCAGGGAGAGCTGCGAGGGCCTCTGCAGCTTCA
GATGGATGTGGTCAGCTTGTTGGAGGCGCCCTTCTGTGGTCCATTATCTCCAGCCCCCTGCGGTGTTGCTGTTTGCTTG
GCTTGTCTGGCTCTCCATGCCTTGTTGGCTCCAAAATGTCATCATGCTGCACCCCAGGAAGAATGTGCAGGCCCATCTC
TTTTATGTGCTTTGGGCTATTTTGATTCCCCGTTGGGTATATTCCCTAGGTAAGACCCAGAAGACACAGGAGGTAGTTG
CTTTGGGAGAGTTTGGACCTATGGGTATGAGGTAATAGACACAGTATCTTCTCTTTCATTTGGTGAGACTGTTAGCTCT
GGCCGCGGACTGAATTCCACACAGCTCACTTGGGAAAACTTTATTCCAAAACATAGTCACATTGAACATTGTGGAGAAT
GAGGGACAGAGAAGAGGCCCTAGATTTGTACATCTGGGTGTTATGTCTATAAATAGAATGCTTTGGTGGTCAACTAGAC
TTGTTCATGTTGACATTTAGTCTTGCCTTTTCGGTGGTCATTTAAAAATTATGTATATCTTGTTTGGAATATAGTGGAG
CTATGGTGTGGCATTTTCATCTGGCTTTTTGTTTAGCTCAGCCCGTCCTGTTATGGGCAGCCTTGAAGCTCAGTAGCTA
ATGAAGAGGTATCCTCACTCCCTCCAGAGAGCGGTCCCCTCACGGCTCATTGAGAGTTTGTCA

SEQ ID:63
>STAR63
GCGTCTGAGCCGCTGGGAACCCATGAGCCCCGTCCATGGAGTTGAGGAAGGGGGTTCGCCCCACGGGGTGGGCGCCCTC
TACACAGCGCGCTTCCTCTTCTCTCGTTAGCGCCGCGGGACCAGCCTCTGGTTCTGCACCTCGCGCTCTGGGAGCAGCG
```

FIG. 26 (CONT)

```
CCCGGCTTTGGCGAGCGCTTCCCCGGGGCTGCCCAGCCTCTGCTCCGCTCGCCCCGCCAGGCCCGGCTCCGCGAAGCCC
CCAGGGTCCAGTCCAAGGCCCCGATTCCCCAAGGCCAGGGCCCCGGGGCAGCATTGGAACAGGGCGCGGACGCCAGTCC
TCCGAGCATGGAGTAACTGCAGCTTTTGAGAAAAGAAAGCGGACCCCACCCCATCGAGAACGCGGCGCCTTGTTTAGGG
ACGTTCCTGGGCCGTCACGGAGTGTCGCCGGCTCCTCGGCCCCTCCCTCCTCCAAGCCCCCACCCCCGACAGCGGCCTC
CCTGGGGACCTCCCCTCGGGCTGCGCTTTCAGCCCAAACACAGGGAGGTCTTCCAGGAGCCTGCCCAGTCCCCACAGCA
GCCCAGAGACCCCCACTCCCACCTGTACCTGCCAAGCCTTCAGAGAGGGCGGCCTGGACATGCCCCGCACGGGAGGAGC
CCCGCCTCAGCACCCCTGCAAGTGGCAGCAACCCAGAACACCCGTGAGAGGCCTCTGAGCAGCCCAGGAAGTGGCTGGA
AGACGCATAGGCAGCTCACTCCTCTGTAAGAGCAAGGACCGGAGAACACATGCTGACCCCTGCTTTTGCAGAGGGGCGA
TGCTTCAGGACAGGCGCGCTCAGCAGGTGTCCATCTTATTTCACACCTTTGTGTTTATATCATCTTATTTTGCATTTTA
TGTCTAATTAACAATATGCAGCTGGCCAGGCGCAGTGGCTCAAGCCTCTAATCCCAGCACTTTGGGAGGCCGAGGCAGG
TGTATCACTTGAGGGCAGGAGTTCGGGACCGGCCTGGGCAACATAGCAAAACCCCATTGCTAATAAAAATACAAAAATT
AGCCAGCCATGGTGGCGGGCACCTGCAGTCCCAGCTACTCCGGAAGCTGAAGCAGGAGAATCACTTGAACCCAGGAGGC
GGAGGTGGCAGTGAGCTATCAAGCCATTACACTCCAGCCTGGGCAACAGAGAAAGACTGTCTCAAAAAAAAATTAATAC
GCAGCAGAATATTATGTGGTCAGCCCAAGCAGTCCCCCCCACTCAGCCCTCTGTCCCTACAGCTCCAGGCACTCCCCCA
GCCCCTCCCCTGGACAAGAGGTAATGCCCAGAGGGTGAAAATCCACCCAAGGTTAAGCCAGAAACAAAAAGCTCAAAGCT
TCGGCATCTCCCTCCGCTCAGACCCTTAGAGCAGATTCCTCTCATCGACAGCACGATCAGGCTGTGG
```

SEQ ID:64
>STAR64

```
AGAGATCTTTTAAGGGCTCAAAAGACCCTGCGGCTCCCCTGCCAATAGCTCTGCCATCGTCCCCAGAGCTTTCGAGGAC
CCTCCACCATCGGCGCCAACCCCAGCTGAGCTGGGTGCTCGTCTGCAGGCCTCTGCTCCATCTCAGCCTGAGCATGAGG
CTCTGCTGTGCTGCTTCCAGCAGCAGGGACAGGGCTGATGAGCCTGGCCCTTGCAAGCATCTTCCTGTGCCGAATACAA
TTCCACAGACAGAGGATTTTAAAATCCAAGTGGAGGTGACAGGAAAGAAAGGAAAACCTCCAGGTATCAGAAGAAAGGAG
GGGGTGTGAAGACAGTATGGGAGGAAGGTCAGGCTGGGGCTCAGCTCTGGGAAGTGCCAGCCTGAACAGGAGTCACGCC
CGGGTCCACATGCAAGGGAATGAGGACCGAGGCCCTGCATGTGGCAGGGCCTTCCGCAGGCTGCCCCGTCTGTGAACAG
GACACCCAGAAGAAGTCTGCCTTCCAGCCTGGCAAAGTGGCAAGGAACCTCTGGGTGGGAAAACAAATCAACAAACAAAT
TGTCAGTAAAAAACAGAAACCTCACACTTTCCTTTCTCTTGACCTCTTGAAAAAAGCAAATCCACTGCAGCTCACCAAA
GGCAAAGAGAAAACCTTAAGAATACCCAGAGAGAAAAGACACGTTACTTGCAAAAGAACATCTAATGCAGGGAGATAAT
GAAAATACAGACTCTTCAAAGGGCTGAAGGAAAAAAACCGTCCACCTAGAATTCTATCCCCAAACTGTCATCTGAGAGC
AAGGGCAAAACAAACGCTTTCTCAGACAGGCTGGACGAGGTCGCTCACGCCTGTAATCCTAGCACTTTGGGAGGCCAAG
GTGGCAGGACCGCTTTAAGCCAGAAGTTTGAGACCAGTGTGGGTAACATAATGAGACCCCATCTCTAAGAAAAAGAAAT
TAAATAAGACAAGACTTTTTCAGACAACAAGTGCTCTGAGAGCTGGCCTATCTTGGCTGTCTTGTAAAGAATTGCTGCG
AGACACCTCATTAGCAAAGAGACTGAATCTAGAAGGAAAGAGCAGAGCATGAGGTACAATGAGGAGCAAATAAACAGGT
CACCCATATAAGCAAACCCAAATACACATTCACTATACGAAACAATAAAAATGACTCATTTGGGGGGTTAAAACACTGTT
GAACTAAAATCCTGGATAACAGCACCATGAAAGGTGGGGTGGTGGTCCCAGGAAAGCATTCAAAGGTCCATGTCTCATT
TGGGAGGAGGGTAGGGAGACTCATGAACTTGAGGCTCCCTTCAGGCAAGCACAGTGCAAAAAAATTATAATAATGGGAA
ACAGATACAGTAGACTGTGATGTACAACTCTCAGAGCAGTAGAAGGGAGGGTATAAAACAAATCTGATCCA
```

SEQ ID:65
>STAR65

```
TCGAGACCAGCCTGGCCAACATGGTGAAACATTGTCTCTATTACAAATACAAAAATTAGCCAGGTGTAGTGGTGCATGC
CTGCAGTCCCAGCCATTTGGGAGGCTGAAGTTGGAGAATCGCTTAAACCTGGGAGGTGGAGGTTGCATTGAGCCGAGAA
GCACTCCAGCCTGGATGACGGAGCAAGACTGTCTCAAAAAGAAAAAAAAAGAAGCAGCAGCAAATATCCCTGTCCTGA
TGGAGGCTATATAACAACCAAACAAGTGAATGCATAAGACAATTTCAAGGTTATGGTAGATACCATAAGTGGGAGATGA
ACAATGAGAACACATGGACACAGGGAGGAGAACATCACACACTGGGGCCTCTCGGGGGTGGGGAAATAGGGGGTGATA
GCATTAGGAGAAATACCTAATGTCGATAACAGGTTAGTGGGTGCAGCAAACCACCATGGCACGTGTATATCTATGTAAC
ACACCTGCACGTTCTGCACATGTATCCCAGAACTTAAAGTATAATAAAAAAAGACATTAAAAAATTATGATATAAAATC
CCAATTCAAGTTGTTTTAAAAAGAGAAAACAATTATCTTTATATAATAGCGGAAAATATAGATGGCGGAATTAAAGCCT
CGTCATATTTTCTAACAGAACTTTCTGATAAACTTGATTAAATAAAAATTTTAAATATCACTAAACACATAGAAGAAAT
AAATTTAAACCTTCACAAAAAATAAAGTACAATGAATGAAGACAAGGTGTACTTGAAAAAGAACTGAATAAATATTCT
ACATATAAAAAAATCTGATGATATTGTGGTGATTCTTTACTTTGCTACTAGTTTCTCTTTTTTTCTTCTGAAAAATTT
CTTGGGATGTATTTGGTTTCATTAGTAAAATTCTAAGTTTCTTTGCAATCTGAACATTGGAGCTTCATCCATAGCCAGT
ATGCCCTAACATTATCTTTGGACAACTGTAAAATTAGAACACTGCCAGACATATTTAATGTATGATGTATATCAACACT
GGGACACATTTTATACTATCTTTATTCCAAAATCAAATGATTCACTGTGGTTTATAAATGTACATGGATATATCTCTAC
CTAAGCAGATAGTTAGGAGAGTTAGTAAAAATGAGGTGGAAAATAGGAGTCACTGTCCCTTCACAGGGAGAGAATTCTG
CTTTTCTCCTAATATACCCTTTGCTTGAACAGACTCCAACCCCTCATCTTTTGTCCTTTAAATGACCACATTTATTTTA
ACTTTGATAAACAACACAGAAGATATTTGATCCATCAACATTCAC
```

SEQ ID:66
>T2F (STAR66F)

```
GCAGGTTGGATGGTGCTGACCCCTCCTCGGGTTGGCTTCCTGTCTCCAGGTGGACGTCCTGTACTCCAGGGTCTGCAAG
CCTAAAAGGAGGGACCCAGGACCCACCACAGACCCGCTGGACCCCAAGGGCCAGGGAGCGATTCTGGCCCTGGCGGGTG
ACCTGGCCTACCAGACCCTCCCGCTCAGGGCCCTGGATGTGGACAGCGGCCCCCTGGAAAACGTGTATGAGAGCATCCG
```

FIG. 26 (CONT)

```
GGAGCTGGGGGACCCTGCTGGCAGGAGCAGCACGTGCGGGGCTGGGACGCCCCCTGCTTCCAGCTGCCCCAGCCTAGGG
AGGGGCTGGAGACCCCTCCCTGCCTCCCTGCCCTGAACACTCAAGGACCTGTGCTCCTTCCTCCAGAGTGAGGCCCGTC
CCCCGCCCCGCCCCGCCTCACAGCTGACAGCGCCAGTCCCAGGTCCCCGGGCTGCCAGCCCGTGAGGTCCGTGAGGTCC
TGGCCGCTCTGACAGCCGCGGCCTCCCCGGGCTCCAGAGAAGGCCCGCGTCTAAATAAAGCGCCAGCGCAGGATGAAAG
CGGCCAGCCTCGCAGCCTGCTCTTCTTGAAAGCTGGGCGGGTTGGGGCGGGGGGCTTCTCTGGAAGGCTTGGAGCTGTC
CCCTCTGGCCTTGGGGGACTGGCTGCCCCGGGGCGCCCGGGCCTAGCCGAGGCGGTGCTCCTGCCGGCCAGACTCTCG
GTCAGTGCGGGCACGGGGTCCCAGCCACTCCTAGGGGGCAGCGCAGCCGGCAGGGTGGCCGCCCCGGGTGGGACTTGG
ACCCTGGACTCCACGGGAGGGCTCCGCCACCCAGCCTGGTGTTACATAAGGGGTGGTGGAGGTGGGCAGTCGAGCGTTA
AAGAGTAACCTGCTGCCGGGAAGCCCGCCAAGCAATCGCGGCCCCTTCCCCGGCTCTGGCAGCTCTGCGAGCGCGCCCG
TGGGGAACGGGCCCTCCCCGGCGGGGCGCGCGGGCGCGCGAGGTGGGCGGAGGCCTCGGAGCTGTGCCGGGCCGGGCCT
CCCTCCCTAGGCCAGCGCGGGAGCGACCCGAGGGGGCGGGCCCGGGGCGGGGCCTCGAAGCGCTGGCCGGCGGGAGCG
CGGCCGGCCGGGCCCGCCCGCCTGCGGTGTGGACGCCGCGCGGCCAATGCGCGCGCCGGGACGGGACGGGACGGGGCGG
GGCGGGGCGGGACGAGACGGGGCGGGGCGGGCGGGCCGGGCAGCCTCCGGGCGGCGCGGCGCGGGCGGCGGCCGGATC
CAGGGCGGGGGTCGGCGGCCCGGCCAGCCCGGCCCGGCCCGGGGCCGCGTCCTGAGAGTCAGCCCTCGCCGCTGCAGCC
TCGGCGCCCGGCCGGCCGGCCATGGAGCGCCCCCGCCCCGCGCCGCCGGCCGGGACCCCAGTGCGCTGCGGGCCGAGG
CGCCGTGGCTGCGCGCGGAGGGTCCGGGGCCGCGCGCCGCGCCCGTGACGGTGCCCACGCCGCCGCAGGTACCGGGCGC
CGGTGGGCGGGGGCGCCGACCCAAGTTTCTCTCGCTGCAAAGATGGCGTCAGTGCTGCCCAAACTTCGGGCCCCCGGGGG
CGGGGCAGCGGGGAGGGCGGCCGCGTCGGTCCGCGCGTGTCCGTGGGTCCCGCCGGGGCTGCGCCGGGCGGCCGGGGAG
CCCTTCCCGCCGCGCCGGGCTGGGGGCGGGGCGGGGGCGGGGCGCGCGCGTCCACACCGGCGCAGCCGGTTTTCGAG
GCGGGCGCCGAGCGGATCCGCGGCGGAGGTTGAGGGACCCCCCTCCCCGGCCACCGCCTCCGCTGAGTCTGCCCCCTC
CCCATCCGCAGGGCTCTTCCGTGGGCGGCGGCTTCGCGGGCTTGGAGTTCGCGCGGCCGCAGGAGTCGGAGCCGCGGGC
CTCGGACCTGGGGGCCCCCCGGACGTGGACGGGGGCGGCGGCGGGGCCCCGGACTCCGTCGGCGCACATCCCCGTCCCA
GCGCAGAGGTGAGCGGGAGGCCCGGTGCCTCGGGACTCGGTGTGCGCAGGGGCGGTGGGTGGGGTGCGGAGACACCGGC
CCCGACGGAGGCCAGGTCAGGGCCCCAGGTTTGTAATTACCAGCCACCCCCAAGCTCTTCAGCCCTGGAGGAGCTGAGC
AGAAATGATCGATGACTGGGAGTCCCTACACCTCCCTCCACCGCAGTTCCTCGGGGCTAGAGCTCAGAACCCGGAGCGG
GTGGCTGTGCGTCTCTGTGCAGAAGAGGCTGCGCGGTCGGCATGGGCGACTGTCCAGGAATCCCTGGGGCTCCTGACC
GCCACCTCCCAACCCCTGCCAGGCCGGACACCTCGGTCTGCTGCCAGGGCAGGGGCGGGCCCTGGCCTGGCTCGCTGG
GGCCTGGGGAGCTGCCCGTGCTTCCAGCCCAGTCTCCCCCTGGCTGCTGCCGGCTGCTGGCCACTCCCACCTCCCAGGC
CTGGCGTGAGGCCCACAGCTGCTGTTGCACAACCCTGGTTAATGTGTGATG

SEQ ID:67
>T2R (STAR66R)
GTTTGGGGTAGAGAGAACATACTGATTATGGGACTTTGCTTTGCAGCTTAGTGCTGTCCTGTCAGTGGGAAGCAACAGG
GGGCAGAACTCAGCTTGTGCCCATAGAGGGAATGTTTATACTAGGCCTGTCCAGAGGCAAATCATCCATCCTAGCAATT
GGAACCTGACTTTTGGCAAGTCCTGCCACCATGGGCTAAAGTGTTCTGGGGTTCTAAATAAACATGAAAGGCAACCTAG
ACCACAAGGACTGCAATTCCTGCACAAGTCCTGGTGCTGTGTTGGGCTTGGAGCCAGGGAACTTGGAGTGCATGGAACC
TAGTGAGATACCAGCTGAGACAACCAAGGAAGTGCTTGTGTCACCCCTCCACCAACCCCAGGCAGTACAGATTGTACCT
CCAAGACCCCTTCCATCTGCTTGAGGAAGGTGGAGGGGAAGAGGACTTTGTTTTGCAACTTGGATTCCAGCCCATCCAC
AGTAGAATAAGGCAACGGGCAGACTCCTAAGGCCCCCATCCCAGACCCTAGCTCCTGGATGACATTTCTAAACACACCA
TGGGCCAGAAGGGAACCCATTGCCTTGAAGGGAAGGGCCCAGTCCTGGCAGAATTTATCATGTGCTGAATAAACAGCCC
TTGGGCCCTGAATAATTAGTATTGGTAGCCAGGCAGTATTTACCACAGGCCTTGGGTGAGACCCAGAGCCATGTTGGCT
TCAGGTGTGACCCAGCACATTCCCAGCTGTGGTAACTTTGGGGAGAGACCACTTCTGCTTGAGAAAAGGAGACAGAAGA
GTAAAGGGGTCTTTATCTTGCAGCCTGGTACCAGCTTGGCCGCAGTGGGGTAGAGCACCAAGAGAGCACCTGGGATAAA
CAAAATCAAAAAACCTTTAGCTAGACTAAGAGTAAAGAGAGAAGACCCAAGTAAATATAATCAAAGACAAAAAAGGAGA
GACATTACAACCAATACCTCAGAAATTCAAAGTATCATTAGCAGCTACTTTGAACAACTATATGCCAGTAAATTGGAAA
ACCTAGAAGAATTATATAAATTCCTAACATATACAACCTACCAAGATTGAACCATGAAGAAATTTAAAGCCTGAATAGG
CCAATAACAAGCAATGAGATTGGAGCCCTAATACAAAGTTTACAATGAGAAACATTGCTCAAACAAATCATAGATGACA
CAAACAAATGGAAAACATCCAATGCTCATGGACAGGAAAAAATATTTAAATTTCTATACTGCCCAAAGCAGTTTATACA
TTCAATGCTATTCCTGTCAAAATACCAATCTTATTCTTCACAAAAAAAAAATTAAAAATTACACAGAACCAAAAAAGAG
CCCAAATACCCAAGGCAATTTTAAGCAAAAAGAACAAAGCTGGAGGCATCACGTTACCTGTGATCCACACTATAGGGCT
ACAGTAAATGAAACAGCAAGGTGCTGGTATACAAACAGACACATAAACCAATGGAATAGAATAAAGAGCTTAGAAATAA
TGCTCCACACCTCCAGCCATCCGATGTTTGAGAAAGTAGACATAAACAAGCAATGAGGAGGAGGACTCCCCTATTCATTAA
ATCAACTCAAGACGGACCAAAAACCTAAATGTAAAACAAACAAACAAAAAAAAATAACTGCTAAAACCCTGGGAGATGAC
CTAGGAAATACCATTCTGGACAGTACCTGGTGAAAATTTCATGCTGAAGACACCAAAAACAATTGCAGCAAAAGAAAAA
ATTGACATATGGGATCAAATTAAACTTTAGAGCTTTTGCACAGCAAAATAAACTATCAACAGAGTAAATAGGCACCCTA
CAGGAAGGGAGAAAATATTTTCAATCTGTGCTCTGACAAAGTCCTAATATCCAGAGCCTATAAGGAACTTAAACAAATT
TACAAACAAAAAACAAACAACACTATTACGAGTTGGAAAAGGACATGAATCGACACTTTTCAAAAGAAGACATACATGT
GGCTAACAAGCATATGAAAAAAATGCTCAACATTACTAATCATTAGAGAAATGCAAATCAAAACCACAATGAGATACCA
TCTCAACCAGTCTGAATGGCTGTTATTAAAAAATCAGAAAAAAACAGATGCTGGCAAGGTTGTGGAGAAAAGGAAACA
CTTATACATTGTTGGGGGAGTGTAAATTAATTCAGCCATTGTGGAAAGTATTGTGGTGATTTTCTAAAGAACTAAAA
GGAATTACTATTTTACCTGGAAATTTCATTATTGGGTATATACCCAAAGAAATATGAATTATTTTACTATAAAGACAGA
TGCATGCATGTGTTCATTGTAGCACTATTCACAGTAGCAAAGACATGTTATCAACCTAAATGCCCATTAACAGTAAACT
GGATAAGGAAAATATGGTACATATACACTGTGGAATACTATGCAGTCATAAAAAGAATGAGATAATGTTCATTGCAGCA
```

FIG. 26 (CONT)

ACATGGATGGAACTGGAGACCATTATCCTTGGGAAACTAACAAAGCAACAG

SEQ ID:68
>T3F
AGATTTGCCCTCAAGATTACAACTGCTGGGGCTAAAGTGGTACAGAGCCTGAGTTCAGTAGGCTTCCATAGTCTCACTC
AAGAATGCAAGTTTACCTCTCAATCTTTCAATCATCACAATTATAACAACTTTAAAAAGAGCCAACATGATATTTGCTT
ATCACTTTTCTACTCACATTCCAGTATTAACTCAAAAGTGTCAACACAACCTTCGTGATAAATACTATTAACGTCATCA
TTCCTACTGTACAGATGATGATAGTGACACATAGGTTAAGTTGCCCAAGGTCTTATTATTAAGGGTCATAGCCAGGATT
TGATCTCTTCAGTAAAGTTCTAGTCAATGCTCTTAACCATTAAGCCATGCAACACACCCAGAGCCAACTGGGTTGTGTT
GATGATTATAATATTTGTTTTAACAAACAATAATTTTTCCTAAATATAATATAGATTTTCCATAAATACCATAAATTCT
TGATTATTTATTTCACTTTATTCCAAAAGGAAGTTGAATTCTGAGATTTAAATGAATAGCAAACAACAGTTGCTTAATT
TCACTACTTTTGTCACTTGTAGCCAGTACTTAAAAGAGATACATAATTTATTTTTGTTGATTTGCATTTCACATATAA
TTGTAAGATCCTGGAGAATAAAGACTATATGTGTTATACCATTTTACTCTCTCACACAGTGTGTAGGCCTAGGCTTTGT
GCATAGCAAGTGTTAAAAAGTAATGTGACTCGTGATAGTTATTAGATTTATTGAAATTCAGAAATTTAGGGAAATGCAC
AATAAAATGTACATTTTGTGATTCCGGTCAAATTACTTAAAAATTATATTTTTCCTATGAATAATTTTTATTTCACTTA
AATTATGTATAACAAAATAACATGCATAATTAAACATTTACCACAAAGAAAATATTTGTACTATTGTTATCACAATAAA
GAACTTGCTACATAAATTCAATTACACTTTTGTGGAAAGTATCTTCATTATATAAAAACAATCTACATTTAGAATAGGA
AAATTGTACAAAACATGAAAATATAAACAAATTAAGCGAGAATTATCTAAAAAGCAACTCTTCAGAATTTAGAAGAATT
GTCTAGAATAAAAAGAATTTAGAAGAATTATCTAAGAAACAACCATAAATATTCTGATGTATTTAAGACTCATATTCTA
GAATCCTGACTATTATTTTTTATACTTCTATGGCTAATCTCAAGTTTAGCTTTATTTTTCTAAAGCAATGAGGCCTGTA
GAATATTTTTCAGAATTCTCTGAGGTTTTTTCTTTTTTGTCTTTCCTGTCATAGTATGCCAATTATTCATGGGTTTAT
AGAATATGTATGCACTGCTAAGAGCAGCAAAACAAAAGATATATGTGCTATTTATTAATTCATGTTGCTTTATTTAAAT
TACTTGAAAATGATAAAGAAAAAACTATTGTATTTACAACAGCAACCAAATATAGACTACCTGTAACTACATCTAACAG
AATAAATAAAATATAACATACAATATGTAGTAAATATATTTATAATATATATGTTCACTAAATAGTTAACCTGTAACTT
ACTTACAGTAAATATATATAATATCTACTGAGATAGTACCACATTTTATTAAGGATTAAACTTTTAATAATTCAGAAGA
ATAAATATAATAAATTTCATTTGTTCTCAAACTAATTTGTTTTTATTTGTTTGTTTTTGTATTTTAATTTGACAGTAG
TTCCAAGATATTTTGGGGTATATAATGAGGTGATAATTGCAAAGAAAATTCTGAAAAGGAAAAGACTAAGCGTGAATTG
AAAGTAAAATTCGTTAAAAGGTATAATAAACTGTGATACTGTAACAATAATTGAAAATAGATAAAGAAAAAGGTAACAT
CAATAAATAGTCTATTATATATGTGAATTATGTTAATAAAAGTGACATTTTATTTTCAATCCACAATTTCTGAAATATA
TATGGCAATATTTTCTGTTTTATTTTTTCAACCTCTGATTACTTTATTACATTTTTTCTTTTTCTAGAATTTACTTG
TATTTTCTCTGTGTCTAATATATGATTATTTCTGAACTAGCATCATTGGTCCTGGAACCAGACTATATTATTCCCAAGG
TAGAGCATCAAAATATAACAATTAAATAAATACTTTTAGTTACTTTAACAACCTTTTGTCTTTCATTATAATTTTGGAA
TTATAGTTTAGTACAATACAGATAGTTTTAATATCTGTTAGAGTGAAGATATATATATATGTGTGTGTGTTTTTGAGAT
GGAGTCTCACTCTGTTGCCCAGGCTGGAGTACAGTGGTGCCATCTCGGCTCACGGCAACCTCTGCGTCCCAGGTTCAAG
CAATTCTCCTGCCTCAGCCTCCCGGGTAGCTGGGACTACAGGCGAGTGTCACCACGCCTGGCTAATTTTTTGTATTTTT
AGTAGAGACAGGGTTTCACCATATTAGCCAGGATGGTCTCGGTCTCCTGACT

SEQ ID:69
>T3R
CTTTTGGTGCCCTGTCCCTTATAATTTCCTCGTGTGTCCTTTCCCATTTGCTTATCCGATGACTTGCTTCTCTCACCCA
TTGGATTGTGAGCCTCTTGTGGTCAGGGGCAGTGCTCTGTAAGCTGCTGTGTCCCCAGAATCTGGCCCAGTGTAGGCAC
TCAGCAGCTATAGACTGATGTTAAGAGAAAATGCACATTTCATCTCAGCCTCAGAGCAGTTCTGGGAAACAGATAGGAA
ACCAAAGCTCTGCAAGAACGTGGGACTCTCTCAGGGCCATCACAACACTGTTGTTGGTCTCATGTTTGGTGACTGGGTC
TCCTATTCCTGGTCTCTTTCCTAGGCATAATGCTTTTATATAAAGTCCCTTCCATTGTTTTTTTGTTTGTTTTCTTTTT
TCAGCCTAAATAACTTAGTTTCTCTAAACTTTTCTCCCAGGGACTCTTTTTTAACCCTTTGAATTATTGCTGATTATTA
TCTTAATAACTTTTATTTTTTTCCATTTTGCATGTCATATTTTAGCAAAGCATTAAAAGGAACACGGCACAAAGCACA
CCCATATTTTTGGATGCTGTGGATTTCATCATGCTGCTTATTCCATTATATCTAGTCAGTACCTCCAAGGCATTAATGC
TGCCTTACCTCCTTCATTCGAAGACTTCCCTGTGCAAGGTGGAATATACGTAAGGAGGCAAACAGACTGGGTTATATGC
CTGCTCTGCTTTACAGAGGCCTCTTCCAGGAGTGTAATACGGGGGTTGCTCATACTCTGAAGAAGATAGTGGCAGGCTA
TTACTGTCATGAGAGCCAGAACGTGGCTGGCTTCTTACAGACATGGCTTCATAGGGCATGCCACGTGATTCCTGAGTA
AGCCTTCTGGTGTGAATTCCCTGCTCACTGGGGTGATTCTTCACTTCCCACAGTTCAACCTGCTGTATTATCCTCTTAC
CTATGCTTTTCTGTGATCCATAGAGGTAATTTAATTTTCAGTCCATGTACCTACCCTGCCTACTTAGTTTCTTCTCAGT
GCCACACTTAATTCCTTCACATTTACTGCCTTTAATAACTGAGGTGATATTCTTTGAGCAGTGTGACCTGTTAGAGGTGC
TCTACATGATGCATTCCCTGAGGCTGCCTTTAATAACTGAGGTGATATTCTTTGAGCAGTGTGACCTGTTAGAGGTGC
CCAGTCAGGTCCGATGAAAAGCCCTCTGATTTGTTGAAATAGTGCATTAGTAAAGTATTATAGTTTATTTTCACAAAGC
TAGATTAGTTGTTACATGTTGGTTTTTGTTTTGCCTAGCCCTAACAAGTATGGAGGTGACCTTGATGTGTCTATAGAAT
ATCAGGAATATCTGGCTGGGTGGGTGGCTCACACCTGTAATCCCAACAATTTGGGAGCCCGAGGTGGGCGGATCACCTG
AGGTCAGGAGTTTGAGAGAGGCCTGGCCAACATGGTGAACCCCGTCTCTACTAAAAATACAAAAATTAGCCAGGTGTG
GTGGCAGGTGCCTGCAATCTCAGCTACTCCGGAGGCTGATGCAGGGGAATCACTTGAACCCGGGAGGTAGAGGTTGCAG
TGAGCCAAGATTGTGCCACTGCACTCCAGCCTGGGCAACAGAGCGAGATTCTGCCTCAAAAAAAAAAAAAAAAAAAAA
AAAAAAAAGAATATCAGGAATATCCATTTTATGTCTCAACTCACATACCTCACAGTTTTCTGGTCCAATTTTTAGGCA
CTTTATCAGGCCCTCATATGTTTTCAAAAATAATTGCTAATGACTTTGATGAAGCTAGGCAAGATATTTTTGGTTTTA
GGGCAGTTTGGGCTATACTTTGCAGCCTTCCTACTTTAATAGAAGAATTTTTAAACTAGATTCTCCCCCTTCTCAGGGT

FIG. 26 (CONT)

```
GGCTTTCTGCCTTTCCATTCTAGTGCTTCACACAGAAATGACAAGCTCACAGGGGACTTATCTAGAAAAGGCCGAGATA
AAAATAAGTACAATGTTAAAAAAATCTATCTTATAGTATCATTTATTTAGAGCTTCCTCTCCTTTTCTAATGAAAGGCT
GCTGTAGTTTCCTTTTGTGCTTTTTTTGCTGAAGGCTTTTCAGTAATATTCCCGTGTGTCCCCTGTGATGCTAAAAGCA
TGAGCTTGGGGGCAGGTTGACTGGCATTCAGGTCTTTGCTCAGCCTCCAGCCGCAAGACAAGGCGAATAATATTGATCT
CATGGAGCTGAAATGAAAATTAACTTTTCTAATCTGTGAAAATGCTTTGTTATAATCCTTAAATACATGAATACATAGG
TTGAAATAGCAAGTACCAAGTGCTGACATTATGTCCACAATTGCCACATGCCATGTCCTTATGATTTTTGCCAGATGTT
TAATAAGATTATAAATGAATAGGTTATTAAATGGGCATCTCCTACTCTCTAGGTGTTTCTGTTTCTGCTTCTCTGTTTT
CTGTTTGTATCTCCATTTATTTTAATGCCTACCATTATGTGAAGTCTGCCACCTTCCTATAC
```

SEQ ID:70
>T5F
```
GAACTCAATAGGGGTCTTGTACGGAGCAGGGGCTTGGTCCCTCGTACCTCTGGCCATACCTATGGAGCCCAGGGGATGC
TTGGCAGCACCTGGGAGGTGCCAACCCCGGGTGGCAAGGGAGGGCCGGTCCCACGCTCACATTGTCTTCTGTTCTCTCT
CTCTCTTTATCTGTGTCGATGTCTCTCTCTCTTCCCCGTGCCCGTGCCATCCTCTCCACCCCTGGATTCCTGTCTCTG
CTTGGCTTTCACCCACTTCTCCTCCCCACCCACGGCTGCTCCTCCTCCTGTCCCCACCTCCTCCCCGGGTGCAGGACGG
GCCTCTTCACACCTGACCTCGCTTTTGAAGCCACAGTGAAAAAGCAGGTGCAGAAGCTCAAAGAGCCCAGTATCAAGTG
TGTGGATATGGTAGTCAGTGAGCTCACAGCCACCATCAGAAAGTGTAGCGAAAAGGTATGACGGCCGCCTGGGCGGGGC
TGGGCCTGGCCGTCCATTCCTTGTGGCCACAGCCTCCCGTGGGCAGAAGGATCTGCTGAGCCGGCCTCACGGCTACCCG
CAGGGACCCAGCCCTAGTGTTTCCTGCCAGTTTCTAACCCTGGGTACTTGCACTCATGACCCCTCCAGGCCCCCATCCC
AGAAGACTTGACTCCAACCCAAGCCTCCTTGGTGGCACCTATGCTAGTGATGAAGATGATGTTAAGGAGATGGCAGCTG
TTTACTGAGCACCTACTATGTGCCAAGCACACGCTAAGTGCTTGCCCTTACTATCTGACTCAGTCCTCTCAACCACCCT
AAGACGTGGGTAGTGTTGTTATTCCCATTTTGCAGATGGCAAAACAGAGTCTCAGAAAAGAGAAGCAGAGTGTGATTCA
GTTTTAGGAAGGACAGAGGAAGGGGTCTGAGGTCAGGGCCTCCTGGGCAGGGGGAGCTGTCCTAGTTCCTCAAAACCAA
TTTGCCTGAAAGCATATTGGATTACTCACTTTACAGTAATCCGTGCGTGAGAGACAGGGGCGGTCTCTTTTGAGTTGTC
TGTGACTTTTTAGATGCCTTTTTCCTATTTGTCTGCTTTTGGGCATTTTGAGGATTTTTAGCCAGGTTGTCTAAAGCAG
TTCTTCCCAGGGGAGTGCGAGAGAATCAGTTGCCTGCAGGAGCTTCTCCAGCAGGCTAAATCAGAGGTGCCAGGGGTGA
GCCCAGCCTCACCTATATCTGAAGGACTTCCCTATGCTGGTGGGTGGAGGCACATCCACCTTAGCATTGAGTTTCAAAT
AAGCATCAATCATCTCCATTCCTTTTTTTTTTTTTTTTTTTTGAGATGGAATCTTGCTCTGTCGCCCAGGCTGGAG
TGCAGTGGCACCATCTTGGCTCACTGCAACCTCTGCCTCCTGGGTTCAAGTATTCTCCTGCCTCAGCCTCCCGGGTGGC
TGGGATTACTAGCATGTACCACCACACCTGGCTAATTTTTGTATTTTTAGTAGAGATGGGGTTTTGCCACGTTGGCCA
```

SEQ ID:71
>T5R
```
GATTACAGGCGTGAGCCACCACACCTGGCCCAGTGGGGTCCTTCTAAAATGCAAAGCTGATCATGTCTCTTCTTCCAGG
CTTAAAGCCCTCCCATGGCTTCCTGCAGCCCTGGTGCACGCCTTACGCCAAGCCTGAAAACACTCTGCACACCCACCCC
TTCCCTGCACAAACGGGCCTCTGCACACTACCTGCCCCGGCCATGCCCCCGCAACCAGCCCTCTCTGCTTATCTACCTT
GGCCTTCTCTCTGGTCAAGCCCCAGGCCCGTCCCTGCCCCTAGGCCTTCACTTAGAGCCTCAGAAGCACTTCTTGCAGG
AAGCCCTCCAGACTCCAGAATGGGTCCAGAACCTACTTCCTTTTCGTGGCATTTCTGTATTCTTTTTTTTTCTTCCA
TAGAGCCAGGGTCTCACTGTGTTTCCTAGGCTAGTCTCGAACTCCTGGGCTCAACTGATCCTCCTGCCTTGGCCTTCCA
TAGTGCTGGGATTACAGGCATGAGTCATTGCACCCGGCCTCCACAGTCTTAATTAATTGGTTGGAGCATTATTTGCATT
AATATCTCTCACCACCCTCCCCATTCCTGTCCAAGACCTCAGGGAGGGCCAGGCCAGATGTATCATCTGCACCAGGGAG
TCCCCTGCAGGGGCTTCCAGATGTCTGCTAAATGAACACACAGCTCTCTCTGGCCAGTCCAAGGCACCCCAGGAGGCCA
CCAGAAGCCTGCAGCCTCCCTCCCTCCCTCCTGCTAAGCCCAAGGAATGAGCACTGAGCAGGGAATGGTAATCTGGACA
CATCCATACTCTGCCCTTCAGAAACTACCTAGCTGTCACCCTGCACGAAACAGGCACCAGCCTGAGAGTCAGGAGGCCT
GGGCTCTGGGTCCACCTAGACAGCTGTGGGGCGCAGGACCAACCGACCGCACCCCAATCTCTAAGCCTGGGTTTTCCATACG
TAAAAAAATGAGGGCAGGGCGGGTTAGACACTAGACCAGATCTGTGATGACAGGCCCGTTGGAAGCCTGGAGGCGGGGC
CCCTCGCTGAAGGAAAATGCCTTACCTCCAGAAGTGGCCCGCCCTGGAGTGGCCAGCAAAGGGGGCATTGCCCCTGCGC
TGGAATACACCCAGAAGCAGGGTGTGAGCAGGAGCTGCGGAGACCTTCAGGGACAGGACAGTCTAGGGAGGGGTGAGC
CCTTTGCAGATCTCCTGCTTATGCCAGGAGAAAGGTAAACACCTCTCAAACACACAAGGAGCCAGGGGCTGTGGGCTG
GAACCTATAGCCGGCAACAGCGTATAGCTTAGGATTTATAGCATTGTTCTACCCTAGTTATGTTTCCTATACTTTTGT
TTGTTTGTTTGTTTGTTTGTTTGTTTGAAATGGAGTCTCACTCTGTCGCCCAGGCTGGAGTGCAATGGCACGATC
TTGGCTCACTGCAGCCTCTGTCTTCCAGGTTCAAGTGATTCTCCTACTTCAGCCTTCCTGAGTAGCTGGAATTACAGG
```

SEQ ID:72
>T7
```
CCATCTTATAAATATATCATAATTTACTGAAAAATATTTCAGTAATGTTGAAAGGCCTCTGTGCCATTTCCAGCTTGAG
GCTATTCCTAAAAATCCTTGCACATGTCTTTCAGTGCACACATGTATACATTTCGGTTGGGTATGCCTAGGAGTGGAAT
GACTGGTTATAGGGTACACTTACGTTGAGCTTTGGTAGATACTACCAACTGCCAGTTTTCCAAAGTTGTACCAATTTAC
ATTCCTACCACCAGTACATGAGGGTTCCAGATGCTGAACGTCCTCACTAATGCTTGGTAATGTCTGCCTTTTTCATTTT
AGTCATTCTGGAGGTAGTGTGATAATATCTCATCGTGGTTATTTGCTTTAGCCTGATGATTAACGATCCTGACCATTTT
TTGGAACATTTGGAGATCATCTTTTGTGAAGTAACTACTCAAATATTTTGCCCATTTTGCTACTGGGTTGTTCAAAAGA
TTCATTAAAAGAACTTCTTTTATATATGGGTTTGTAGTTGTTATTTAGATATTCTAGAGACTAGCCAGATCCCTATACT
ACAAATACTTTCTCCTACTTTGTAGTTTGCCTTTTTACTTTCTTTTATATACATATAATTTTTCCCCCTCCAAAAGACA
```

FIG. 26 (CONT)

GGGTCTTGCTCTGTTGCCCAGGCTGGAGTGTAGTGGTGCAATCATAGCTCACTGCAGCCTTGAACTCCTAAGCTCAAGC
AATCCTCCTTCCTCAGACTCTGGAGTAGTTGGAACAATAGGCACATGGCATTATGCGCAGTCAACTTTAAAAAAAAAAA
AAATTGTAGAGATGAGGTCTTACTATGTTGTTGCCCAGGCTGATCTTTAACTCCTGGTCTAAAGCAATCCTCCTGCCTC
AGCCTCCCTCCCAAGTAGCTAAGAATACAGGTGTGCACCACCACATCTAGCTTTACTTTCTTAATGGCGTCTTTTAATG
AACAGATAATTCCTAAGTTTGATGTAGTCAAATCATCATTTTTTCCTTTATAGTCAGCATTTATATCCAGTTCAAGTAA
AGAATATCATGAAAACATTCTTCTTTGTTTTCTTTTAGAAACTTTCATAAAGTAGCATTTAAAATGTGAATTTTCCTAT
AATCCTAGCACTTCAGGAGGCTGTGCCACCGCACTCTAGCCTGGGCAACAGAGCGAGACCTTGTCTCAAAATAAAAAAT
TAAAAAAAAAAAT

SEQ ID:73
>T9F
TGAGCATCTCTGAACTATTGCGCCATGTATTTCCAATTTTCATATTGTGTATTTGTATATTTTATATGTAATAGTATAG
GTGTAATATGTAAATATATTTTATATGTATTTAAAATCTTTATATTTTGAAGGGTTTTGTTTCAACTATTACTTGTTAA
TTTCACAGTCCCTTTCTTTGATGTTAGCAAATAGTACCTTCATGAACCTCAGAGGACTTGGATCTGAATGTGCAATGCC
CTCTAGTATTTCAAATAATAGTTCAGTTGGTATAGTATTTTTTTAATCTGCAAAAAACAATACTTGCTAATATAGCTAT
GTTAGAGTAAACAATAAATCGAGAATAAATTTATAGCCTTTGAAACAAAACAAACCAAAATTTTACTCCTTTTTGGCT
TTCATCCCTGCACTGGTATCTTAACTTCTGTTTGTATAAAAGAATACCATTTTTTCACAGAAGACAAAGAACAATCAGC
CAATCTAATAATTATTTTATGGCCATGCTCTGAAATACAATTAAAATTATGATTGTGGACAATATGCCTTTTCGGGACC
TGGCTGATGGTATTTCTGGTGTGACCCCAACTTTCCAGTCAGTTCAGGGCAATAAACATTGGATACAGGACAGCTTTGG
GGATGAAATAGAATTAAATTTAGTGTAGTTTTTGCCACTTTTAGCTGGATGCCTGGCGAGGGGTTTTGTGCCCTCTGAG
AGCCTCCGTCTTCTCAACTGAGGGGTGGTTGTGAGTTTTGGGTCAAATGCTTGGTGTTTAGTAGATGCTTGGAGCTTCC
ATGAAACATGCAACCACGGCGTTGCTGCTATTTGTTCAGATGCGAGAGGAACATGACTTTTGGCTGCCTGAGTGTTCTC
ATAGCATCTGGGCCTTCCTTGTGAGATCGTCAGAAAGTGTTTCCTGCACAAAGCCTGTACTGCGGCCCTGGCGTGGGGC
TGATTGTCCCGCTACTCTGCTGTGATGGCTGAATTCAAAGAGTGGCCGATAGGAGCACGTATGGTGGGTGCCTTGTTAA
CAGCTCATAGCAGAAACGTGACAAGCGGGAGAGGCTTTGGGTTGTCCTGAACTTCAAACACCTGTAACTGCTGCGGGA
AGAGCGGCACGTGGATGAAACGGACACAGAGGGGGAATAGGCAGGAAAGGACGCGGGCTCTTTTCGAAGCAGCAGGTCT
CAAGGCGGCCAGCCACTGGCGCAGCTGCAGCTGAAGCCACGGCAGAGTCTCCATCCTTCCCACTATCTGCTGAATCAGA
GAAAGTGGCAGGCAACATTTTTAGTGCCTTAAATTTAGAACGCTTGCTCAAAATCAGACCCTACTTAAAATAAGGAGCG
ATACCCTCATTTCTTAAATAGTAAAAATGCCCTCAGCAGAATTAACGGGAGTATCTTCCAACTTCATATCCTGAATGGA
AAAGTCTGTCCACCATCCCGAGGACGTGTTTGAAGCGCAGTGTGAAAATCCAGCACGTCGTGGACCGGCCAGACCCCTG
TGCCGTGAGAGGCGGGGCGGCGGGGCCGTGGGCGCTCGCACTCCCGAGCTCATCGTGGCATGCGCTGAGCCGAAAACC
ACGAGGTAGAGGGAATGAGATC

SEQ ID:74
>T9R
GAGCTTGATTGTCTGGCCGCGAAAACAGGGCAGGCCCGTGTCCAACATGATAGTGACCAGGGAGACGACCACATCCATG
TAGGGCCTGGGGAGAGACAGGAGGGAGCGGTGGGCTGAGGCCAGCCTAGGTGGTGGCCCTGCCTGTAGTCCTGTGGACT
GGCTGATGCCAACAGCCTCAGGTGTGGGCTCCTGCCACCCACCTCGCCTGCCACATCTTGCACATCCCCGAGGCAACTT
TCGATCTGCTGCACTCGGTCACCCGTACTGCCCAGGCAAGGGCTGCCCATACGCACTCTGGACAGGCTGAGTGTCCTGC
CCTGTCCCCCACATAAGGCTGCCGGCCATGGCTTCTGCACCTGGGTGGGATGCAGACACGCTGACCTGCCTTTCTCTGC
GGGGCAGTGGGGATGAACCCAGGTTGGACTGTGGCCTTGGCCAAGTGACCTGTATATGAAACTGGGACAAAGCCCATCT
TTGGCACGTAGCCTGTGGGGTGGCAGGTGCTCAGGCTTTGGTGACAAGGTGGATGGGATGCCCAGAAAGGGAGAGCCCA
TGGCTGAAGGCGTGGCCAGGCATTGTGGGGAAGGTGGTTGGAATTAGATGCCCAGAGCAAGAATTTATTGGCACAGGTGG
GCAGACAGAGGTGACCAAAGGACAGGTGTAGGTCAGCAGGTGGCTGCTAGCACCTACCTCACTCTCTGGAACCCGATTC
CCTTCATCCTAAAGGGGATCTCAGAACGTTCCACACACCCCCTCCGCCTCCACCCTGGCCCTCACCCAGGCTCACCGCA
CAGCCAGGTAGCCTGGACACACATCTCCATGAACCACTTGAAGGGTGTGGCCTCCATCTTGCCCCCCATGATCATCACC
ATCTCATCCGTCAGCTTGATGTCGGGTTCCCAGCCGAGATTGCCGCCCGGCGAGCTTTCAAACATGAAGCCAAAGTCTG
CAAAACCCCAAAGAGCTGCCTGTGACTGGGTAGGAGCCAGGGCGGGCAAGGACGAGTGGTCTGTTTTGAGGAGTGGAAA
AGGACTCTTCAACAGGAGCACCCCCTCCACCCCCAAAAGGCAGGTTGTGTTTTCTTGGAGACAGTGATGGGGTGGGTGG
TGGGGCAGCAGGCAGAGAAAGAGGAAGGGAGGAAGTGGAGGAAGGAGCCAAGCTGGGGCACTGAACCTGGACCAGCCCCA
CTCCGCCCAGCTCCAGCTTCTGACTCAGAGCAATGGCGGCTCTCGCCCCAGCTCCCTGGGGCCGGGGCCAGGCACCCTC
TACAGCAGAACAGCTTGGTGGCCGACAGTTCGGACCTCAGAGCTGGACCCTGACACTCCTGGCAGGGTGGTCCTGGGCA
TTCTCCTCTCTGTGGGGTGGGGATCCCTATCCACCCCTGGGTGCCGGGGTGAAGGGAGAGGAGGGTGGCGCTGTGGCTG
GCTGACCGATGTGGATCATATGGCCCTTCTTGTCCAGCATAATGTTGCCGTTGTGTCTGTCCTTGATCTGCAGCAGGAA
CAGCAGGAGGCTGTAGGCGGCCATGCTTCGGATGAAGTTGTAGCGGGCCTGTGCAGAGAGCGCCCTGGGCTCAAAAGG
CCCTGGGGCCTGTGGGCATTCT

SEQ ID:75
>T10F
AATCAAACTGGACCCTTATCTTCCACCATATACAAAAATTAATGCAAGGTGGATTAAAGATTTAATTGTAAGGCCTCAA
ACTATAAAATCTTAAAAGGAAACCTAGGAAATACCATCTGGACATCAGCCTTGGGACATAATTTATAACTAAGTCCTCA
AAAGCAATTGCAACAAAAAACAAAAACTGACAAGTGAGACCTAATTAAACTAAAGAACTTTTGCACAGCAAAAGAAACT
ATCAACAGAATAAACAGACAACCTACAGAATGGGAGAAAATACTTGCAAACTATGCATCCAACAAAGGTTTAATATCCA

FIG. 26 (CONT)

GAATCCATAAGGCACTTAAACAACTCAACAAACAAAAAACAAATAACTTCATTTAAAAAAAGACATGAACAGACACTTC
TCAAAAGAAGACATACAAGTAGACAAAAAACATAGGAAAAAAATACTTACCATCACTAATCATCAGAAAAATGCAAATC
TAAACCATAATGAGATATCATCTCACACCAGTCCAAATGGCCATTAATAAAAAGACAAAAAACAACAGAAGCTGGCAAG
GCTGTGGAGAAAAAGGAACACTTATACACTTTTGGTGGGAAAGTAAATTAGTTCAGCCACTGTGGAAAGCAGTTTGGAG
ATTTCTCAAAGAACTAAAAATAGAACTACCATATGACCCAACAATTCCATTACTGGTTAGATACCCAGAGGAAAATAAA
TTGTTCTACAAAAAAGACATGTGCACTTGTATGTTCATTGCAGCACTATTCACAATAGCAAAGACATGAAATCAACCTA
GGTGCCTGTCAGCAGTGAATTGGATAAAGAAAATGTGGTACATATACACCATGGAATACTACACAGCCATAATAGAAGA
ATGAAATCATGTTCTTTGCAGCAACATGGATCCAGCTGGAGGCCATCATCCTAAGCGAATTAACAGAGGAACAAAAAAC
CAAATACCACATGTCCTCACTTGCAAATGAGAGGTATATATAGACATAAACATGGGAACAATGGACACTGGGGACTCCT
GGAGGAGGGAAAGAAGTGGCAGGCAAAGGGTTGAAAAACTACTTATTGGGTACTATACTCACTACCTGGGTAATCCGCT
AGTAGGGATCATTTGTTCCCCAAACCTCAGTATCACATAATATACCCATGTAACAAACCTGCACATGTACCCCCGAATC
TAAAATAAAAGTTGCAATTATTAAAATAAAATAAAAATAAAGCTAGCAATGAGCCCTATACATGAAAATCAATAAAACA
TAATCATGGCTGTATAGAGGGGCTTGTCATTTATAGC

SEQ ID:76
>T10R
AATTTTACACACACACACACACACACACACACACACACACAATATCGCTCAGCCTTAAAAACATGCTACTAATCGGC
TTTAAGAAAAGAAGAAAATTCTGTCATTTCTGACACCATGGAAGAACTTCAACATTACGTTAGGTGAACTAATTCAGGT
ACAGAAGAATACTACAGTATCTCACTTATATATGGAATGTAAAAATGTTGAACTCAAAAGTAGAGAATGGAATGGTGGT
TACCAGGCCTTGAGAGAGAGGGGTAAAGGTTGGTCAAAAGATGCAAATTTCAGTTAAGAGGAAGGAGTACAAGAGATT
TATTGTACATCATGGTGACTATAATTGATAACAATGTGCTTTTTTCTTGACAATTGCTAAGAGTAGAATTTGTTTATGG
GCACCAAGCTTGATTCCAAGTCTTTGCTATTGTGAATAGTGCTGCCATGAACATGCAAATGCGTGTGTCTTTTTGGTAG
AATGATTTGTTTTCTTTTGGATATATACCCACTAATGGGATTGCTGGGTCAAATGGTAGTTCTAAGTTCTTTGAGAAAT
CTACAAACTGCTTTCTGTGGTGGCCAAACTAATTTACACTCCCATTAACTGTGTCTAAGTGTTCCCTTTTCTCCATGTC
CTCACCAGCATCTGTTGTTTTTTGACTTTTTAATAATAGCCATTCTGACTGGTGTAAGGAGGTATGCCATTGTGGTTT
GATTTGCATTTCTCTGATTAGTAAAATGAAGCATTTTTTCTATCTTTGTCAGCCATGTATATGTCTTCTTTTGAGAAAT
ATCTGTTCATTTATTTTGCCCACTTTTAAATGAGGTTATTTGGTTTTGCTTGTTCAATTGTTTAAATTCTTTATCGATG
CTGTATATTAGACCTTTGTTGAATGTGTAGTTTTGAGAATATTTTCTCTCCTTCTGTAGGTTGTCTGTTTACTCTTTTG
ATAGTTTATTTTGCTGTGCAGAAACTCTTTAGTTTAATTGGGCCTCATTTGTCAATTTTTGCTTTCGTTGTACTTGCTT
TTGGTGACATTGTCACAAATTCTTTCCTAAGGTCAATGTTCAAAATGGTGTTTCCTAGGTCTTCTTCTAAAAGTCTTAT
AGTTTGAGGGTTTACATTTAAATCTTTAATCTATCTTAAGTTAATATTTGTATATGGTGAGAGAAAGGGGTCCAGTTTA
ATTCTTTTGCATATGACTAGCCAGCTATCCCAGCACTATTTATTAAATAGGGAGTACTTTCCTCATTGCTTATTTTTGT
CGACTTTGTTCAAGATCAGATGGCTGTAGGTGTGTG

SEQ ID:77
>T11F
TCTTTGGGGTATGATTATATGTCTAGGTAAAACTCTTTTAAGAAGATGAAGCAGAGAGGATTGAATTGACAAAGACAGC
TCTTTAAAAATTAAGGTTATTTCAAGACTAAGAACATAACTGCTTAATTGCAGGTAATAACAGAAAAAACTTGGAAATA
AACATCCCATTATTTGACCTCCAAGGCAGAAGACTGGCACCAAGGAAATGGCAGCTTCGTCCCTTTCCTGTCTTGGGCA
TTGGTAAAAGGAGTTGTCTAGACATGTTTGATTTCTGTTTCAGCCCTTATTAGTAGTTATGCCATGGCAAATTATTCAA
TTTCTCTGACTCAGTTTCCTTATTCAGAAATGGAAGCATAATTCTTGCCTCATAGGGCCATGAAGATTAAATGAGGGG
TGTCTTGAAGTGTCTGGGACATAAATCTTCAATAAAAGCTAATTCCTTTTTTTTACAGTTATCTCAAACCTTTTAGTGA
ATTGGTGCTTATCAGTGAGCTTTTTAGGTGATGCAAAGACCCTGCTTTGCTCATTTTAAGGAACAGTTATTTTCTTTC
TCCATTTTGAAGTTTCTTGTTTGCTGCCTGGTTGATATGGTTTGGCTGTGTCCCACCCATATCTCATCTTGAATTGTA
GTTCCCATAATCCCCACATGTCATGGGAGGGACCTGGTGGGAGGTAATTGAACCATGGGGTGGTTACCCTCATGCTGT
TCTTGTGATAGTGAGTGAGTTCTCACAAGAGCTGATGGTTTTATAAGGGGCTTCCCCCTTCGCTTGGCACTCATTCTCT
CTCCTGTTACCCTGTGAAGAGGTGTCTCCTGCCGTGATTGTAAGTTTCCCGAGGCCTCCCGGCCATGTGAAACTGTGAG
TCAATTAAACCTCTTTTCTTTATAAATTACCAAGTCTTGGGTATTCCTTCAAAGCAGCATGAGAACAGACTAATACATT
GGTTTAAATTAGAATGCCAAAATTTAAATAATTTTTATCTTGAATAGTAGATGGAATTAACTTTCTCTTGAAAGATATA
TTTTAAAAAATTGAACTTACACAGACAGTTTTGAAATGGTCTTATTTTAGTTTTATTTATTTATTTTGAGACAGA
GTCTCACAGTGTCGCCCAGGCTGGAGTGCAATGGCACAATCTCGGCTCACTGCAACCTCCACCTCCAGGGTCAAGCGAT
TCTCTTGCCTCAGCTTCCTGAGTAGCTGGGATTATAGGCGCCCACCACCATGCCCAGCTAATTTTTGTGTTTTTAGTAG
AGACGGGGTTTCACCATGTTGGCCAGGCTGGTCTCGAACTCCTGACATCGTGATTCTCCCACCTCGGCCTCCCAAAGTC
TCAGGATTACAGGCATGAACCACCGCGCCTGGCTGAAATTGTTTTTATTATAGATGTTGCTTGTGCAGTTTTGTTAGAA
GTTCGTGACTTTTAACAGTGATGAAAATACTTCGTCATTCAACAGGTTATTTTTCTGCTGGTTGTAGGTTATTTGTAAG
GAACTGTTAGTCTCCTATCTGGGTGGACATGTAATAGTATCAGTTACTGAACCAGAACTTTAAACACCTTTCTGATACT
CACACTGGGAGGTCACCAAGTATCTCAGAATAAAATGTCCCAAACTGAACCTACCATGTTCCCAGAAACCAGCCCTTC
TCAAATTCCCAGACTTGGTGAATGGGAGCCTGTCCTTGCAGTCTTGTAGCCCAAAACCTAGGGCTTAAGAACACCTTCT
TCCTTACTCCCATATGCAACCCATCAAGTTCCATGCATTTCATCTCCTAATCTCAAATCCCTTCACCCATCTCCACAGC
CACCCCGCTAGTCCGGGCTGCCATTGTCTCTCACTTAAAATGTTGTTATTGTCTAACTGACCTTCCTGAACCCTTTCTT
GCCTCTTTCCAGTTTATTTTCCACACTACAGCCAGAAAAAGCTTTTCAAAATACGCATCTGGTCACCTGCATACCTGTC
TCCAGACCACATACAATAAGCCTTCA

FIG. 26 (CONT)

SEQ ID:78
>T11R
TCTGCCAGCGGCTCCCGCGCCAGGTCCTCGAAGCGCACCAGGCGGTAGCGGCCGCGCAGGAAGGGTGGCGGCTTGAGTG
TGGCGGCCTCGGCGATGCGCACGTGGCTGCGGCACACCTCGCGAATCAGGCGCAGGTGAGGGTCGGCCTCCACCCACTT
GCCGTTGGTGCCCAGCACGATGCCGTTGTCGCGTGCCAGTATCGGGCCCGCCGCCTCCCGGGAGCGCAGCACGGCCCGC
GGGTCGCGCACCAGGTGCACGATGCGCAGGTTGAGCGCGGGGTCGCTGAGCAGCGGGTAGAGCACCTGCAGGTTGAAGA
AGCGCACCTCCTTGAGCACCACGTGGCTCTAGGAGCGGCAGGCCTCCCGGGCCAGGCTGAATGGCTGCCGCCTGCACAG
TGTCTTGCATACGTCCTGCTTGCTGATGGTGCCTCGGGGAAAGGCGCTGCAGGCGGGCGGCGAGCACAGCGCGCGGCTC
GTTGCCCAGTTGAAAAAGGCGGACAGGTTTCGGCTCTGTGGCATGTAGGCATCAAACACGTCCATGTCGCACAAAAAGA
TAGAGCGCATCAGGTCGCGCACGGCCATGTGCAGCGTTGCCGCGCTGCCCTGCCACAGGGTGGTCCACACATGCCACGC
GGGCTCCATCAGGTAGAAGACGTCGGGGTGCTGGCTGAAGAGCTGGCCCAAGAAGCATGACCCCGAGCGCCACGAGGAC
AGCACCAGCACGTGCACACGATCCTCGCCGCCGGCTGGGGATGAGGGCCCTGGCCGGAGATGATGAACAGCAGGAGGC
AGGTGGTCTGTGCCAGGAGGAGCACTGTCACTGTCTTGCTGGAGAACCGTGGCAGCCACATGCGGGCGGCTGGGGGCCT
TCGGGTGGAGTGGGCAACTTTAGGGACCCGGGCCCTCATGCCCATCCCATGCCCCAATTACTGCCCAGTGCCCTCAGGG
ATCAGCCCTCAGATTCGGCTACCCTACCCATTGGACTTCCCAAGACTCCCAAGGTCTCAGTCGAGCACTTTCCCAGGAA
TACGGAGTCAAGACATAGGCCAGAATATAGTCTGTGCTCACAGCAGAAGTCCAGTTGCAGAATAATGTGGGATATCATC
AAACTGTCTACCTACCCACCCACCCACCTACTTACATACCTACAGGCTATCTATCTGTAGAGAGAAATACTATGTTTCA
AAGAGAACTCCTGTCTCTTTTGCTTCAGGATACCTCTTAGAGAGACCCTTTTAGGTTGTGGAGCTAAAAGGCTTGATGGG
GGCTTCGGTGGATGTCAGAGCACCACCAGGCTCGCCGAGGTTGAATCCTGGCTCTGCCACTTCCTAGCCTATGATCTTG
CTTATGAAGATCACTTAAATCTCTCTGTGACGGATCACTTTACCCGTGTGTGAAAGAGGGATAATTCCGGTACCTGGCT
CACAGGATCTGGGGGGATTGGGGGGTTATTATAATGAAGATGGGGGAAGGGAACACGCAGTCATGCCCATAACTGAGGA
TTGCACCTTTTACAAGGTGTGCTTCTGTATTATATAATTTTTTTAACAGGCAGGTATAAAACTTTTGTCAGCCAGGCGC
GGTGGCTCACGCCTGTAATCCCAGCATTATGGGAGGCCGAGGCGGGCGGATCACGAGGTCAGGAGATCGAGACCATCCT
GGCTAACACAGTGAGACCCCATCTCTACTAAAAATACAAAAAATTAGCCAGGCGTGATGGTGGGCGCCTGTAGTCCCAG
CTACTCGGGAGGCTGAGGCAGGAGAATGGCGTGAACCTGGGAGGCAGAGGTGGCAGTGAGCTGAGATTGCGCCACTGCA
CTGCAGCCTGAGTGAAGAGTGAGACTCCGTTTCAAAAAAAAAAAAAAAACAACAAAAAAAAAACTTTTGTCATTAAAG
ATAAACAAGTAAATAAAGTGGACAAAGAACAGCAACTGTTGTCATCACTGGTGGGGAGTGAAGTGCTGTAGGCAGCATG
GGCTCCAGAAGGAGGGTGTCCTGGAG

SEQ ID:79
>T12
TGGCATCCAGCATGGAGCCCACAGCTTCCCTTTGTAGAATTGCCCAGTTGTTGCAGAGTGCTTTGGTCTCAATGGGTCT
AAAGCTCTTGATGATATAAGAGCTTCAACTTCCTTTTCCCTCTCCTCCCCGCAGGCTGCACAATGTCCTGGTGAATCAC
CTGGGACTTCAGAGCTCTGCCACCCTGGGTGTGAAGCTCAGGTCTGCTCTTGGTAGCTTGGTCAGTGTGAAGTACACCG
TGATTTTGGGCAAGCTGCTTAACCTCCCTGGCCCTCCGTTTCCTCATCTGTAGAATGGGGATATTCACAGAACCTACTT
GTAGGGCCATGGTGAGGATTAAATGATGAACAGTGCTGGCAAACAGGAAATGCTATATAAGTGTCCCTAGCAATATACA
CACCGCACATCCTCAGTCACCACGTGTGTTCACTGAGGTATGGGCCATGTGTGGGTGGAATTGTGTTCCCTAAAAAGAT
ATGTTGATGTGCTAACTTGAGGTCCCTGTGAATGCAGGAAACCAAAATATTTCTTCTCAAAATAGTGAGGATTGTTAAG
TTAAAGACACTGAAAATGCAGCGCAACACTGCCTTGGCCTCTACTTGCCTGATGACAGGCACGAATCCTTCCTTACTTA
AGACACATCACTTGCTTATCAGCCCAGAGAAAGCACCTGCAGGCACCAGGAAAATCTAGGAACAGATTTTACTCTCTTC
CCACATTTTCCCACTTTTTCAAACACTGAAACTGCTCTCTCCTTTGTCTTGTCACTAGATAGGATTTATGGCTCTTTGT
TAAAATATTGTTTAAGCAAGGCTTCTACGCCACTAGCTTGAGAGAGAAATACTTTTGAACTGAGGCCTCTTCCGCATGA
TAGGCAGAGCATGCATTAATACATTTCTGCTTGTTTCTCTTTTGTTAATCTGACTTTTTGTTTTCCAGAGTGTCTCAAAT
AAGAACATAAAAGGGAGGGGAGAAATTATAGTTTCTCCCCTACATGAACTTATTCGGATATAGGGTCTTTGCAGATGTA
ATCAAGTTAAGATGAAGTCATATTTGATTAGGATAGGCCCTAATTAAATATGGTTGCTGTCTTTATAAAATGAGAAGAA
GAGACCAGGTGTGGTGGCTCACACCTATAATCCCAGAACTTTGGGATGCCAAGGCAGGATTGCTTGAGGCCAGGAG
TTTGAGACTAGCCTGGGCAACACAGCAAGACTCCATCTCCAAAAAAATTAAAAATTAGCTGGGCATGGTGGCATGCACC
TGTAGCCCCAGCTACTTGGTGGGCTGAGGCAGGAGGATCAATTGATCCCAAGAGTTCAAAGCTGCAGTGAGCTATGATG
GCACCACGGCAACCTGGGTGACAGAGCGAGACCCTGTCTCTTAAAGAAGAAAAAAAGAGGAGAAAAAAACAGAGACACA
GAAAAAGTCCTTGGGATGATAAATGCAGAAATTGGAGCCATATATCCACAAGACAAGGAACCACCAGGATTCTTGGGA
ACTCCAGAAGCTAAGAAGAGGGCATGGAACAGGTTCTACCCTAGGGCCTTCAGAGGGAGCGCAGCCCTGCAGACACCCT
GAGTTCAGACTTCTGGCCTCCAGAACTGCGAAAGAATAACTTTCTGTTGTTACAGCAGCCCTAAGGCACTAGTACAGGT
GACATGTATTGCTCTTCTGAAGAGCAGGGTGTCTACAGCGGCAGAGGTCTGGGTCCTGGCACGTGCCCTTTAGGATTCC
AATATCCTTAGGGGCCTGCTGGTGCTGACAGTTCCAGAACCATAAGACAGAATTCCTGCGGGCCAGTTTGGAAGCAGAG
ACAGGAAACTGGAAGAGCCCTTAGCCTGTGCTTGGGCTTAAAGCCCTTTAGCTTGTGGCTTTAACTCTGAAACTTCTAG
AGGGCATCTTGCAGGTCAGTGTGAGGTACAGAAGTTGTCACAAGCTTCCTGGCTCAAAGAAAGTGAGACTTCACGAACT
TTTCTGGACATCACACCAGCACTTATGAAGTTATCTTGTTAAGCACAGATGAAATCAGAAATACAGGCATTCACCATCA
CTTAAACAAAGCTCAGATTGTAGAGTGCGAGGAAGAATCGGTGGGA

SEQ ID:80
>T13F
CAGATCTCTAAAGTATTGGGTCTGCACTAGAGCTCTGGACGGCCTAAAGGAAAGGAATGTGCCGGTTCACAGGGACCCG
CGGCTAAGCTCAAGGGTAAAATACAGCTTTACAAACCATCTTTAGGCTGTTCCTTCCCAAACGTGCTTAGAAGGGAACA

FIG. 26 (CONT)

GGGAAAGGCGGGTGTGTTTTCTCACTGAGGTTCTTCTAGTGGCTGGAATCTGATAGAGTACCAAGTTGTAGGGATATGG
ATATATTTTCCCTTTGGCACTCCATAAAGCTAAATGTTGGGCTGAAAAAAGGATGCAGCCTATAAACAAGTATTTTTCC
TGAAACCAACTGCATGAGGAAACGCTGCGCTCCCCCTCAGGGAGCAGTTTCTGAAGCCAGCTGAGCACAGCTGGCACTG
GCCAGAGGGAGCCCTCCACCCTCCCACCACGTATGCCCACCTGCAAACCTGGGTTCTGAGTCCCCATGCAGGGGACAGA
CCTGAAAATTCCAGTTTGTGTCCTTTCAGGTCATCGACAGGAATGACAGCCTGGCAAGCTGCAGTGACTGCACACAGCT
ACCCTGTGAGCTCCACTTGTGTGGGTGCAGGTGGGCGACAGGAGTGTGTGACACAGACAGGCACTCCACCAGGAGGAAA
CCCACAGCAGACGTCAACCATCGCTTTATTAAGGCTCCCAGTCGGGGGCTGAGTCATGCACTCCACAGACACCCCCAC
TGCTCCCAAGGTCCACTTTTGGATGACCCTGAAGGCAGAGACTCCTGAGATCTGGGCCACAATCTAGGGTGAGCCACCC
ACAGTGCCCTGCTGGACAGGGGGGTATGCGGACTGCACGGGGGGGCCCTCAGCACGGGTCTTCCTGCCTAGGGTGGGGC
TGGCTCCAGTGGGTCCTGGGCTCAGGCAGGGGGGTGGCAGGGAGGCAGGGACATCCCCCCGCCCTCTGGCCTATGGCT
TTGTTGCCCTATTGCCACCAGCGCAGAAGCAATGTGCTATACCGTGAGGTGATGAAGAAGAGCCCCGGGAGGGAGCAGG
CAGCTCTGTGCCTGGGGCCTGGCCAGACCTCAGGGGTGCTGTGGCCCTGCTCCTGTTCCCCCTCAGCTCCTCCCAGCAA
TGGGTCTCCTCCAGTGGAGGTCAGTCACTCAGAAGTGGACCCGCAGCACGTCTTGGCTAGCAACCGGCCGCTGGCAGGC
TGTGCACGTCATGGGCAGGGAGCGTTGCTTCTCACCCAGGCAGGGTCGGCACAGGAGGTGGCCGCAGGGCAGCTGGTAC
ACCGGCTCCTTTTTGAAGTAGGGAGAAAATACTCTTTTGCAGGAGGCACATTCGCGCCCCAGGATGCTCCCAGGCTGCT
CTGGTAAATCAGGAAGGAAAACAGGCCAGGGTTAGGAAAGCTGCTCCATGGTCCAGGCTGCTCTGAGGGGCAGAGCCTT
CCCACCGTGCTGCTGCAGCATCTGGCTTCATCCCTCCCGAGTCCATCCCAGTCTGATCAGGTAGGGGAGTGGAAGCCGG
AGAGGGAGCCTGGGAACCCGGGAGGCCTCTTCTCTATCATCTTTGACCAAATCTCAGTGCCTCTACGAATGCTTGAGAA
GAGCTGGCTTCTGAGGGCAGCAGGCAGGACTGGGCCCTTCCTCCTGGTCTCCCAGCAAGGTTTACTTTCCCCTGCGATA
GGTGGCCAAGGCTGGAGCAAGGCACAGCTCACTCTGACAAG

SEQ ID:81
>T13R
GAATCTGACCACTCAGTCCCACATCCCAGGATTCAGAGAAAAAGAATTCCAGTGAGGGCTCTGGACCCCACACAGCTAA
GGCTTCCAGGGTTTAGGCAAGCCCTGAGGGACACCCATCATAATTACCCAGACGGGGGCCCAGCATCCCGCCCCAGCAT
TCTGCCTTGCAAGGAGCTCCCTCACCAGGGCTCAGGGAAGGGACAGCCTGCAGTTCCAGCAAGGGAGGCCTGCAGAGTC
AGCCACAGGTGGCCACTATCGGTTGCTTGGTGCCAACTTAGTGTGAGGGGGCAGGGCCCAGACTCGAGGGTGCCATTAC
CGTCCCCCATCGTGTACTTCTTTTCCTCGTAGCTTGAGTCTGTGTATTCCAGGAGCAGGCGGATGGAATGGGCCAGCTG
GGAGAGATGGCCCACAGCTCGGGTCAGAGATGGAGGGTCCCTGACTTTGTGACGACTCTGCACAAGGGGAGCCCCATCT
CCTCCTCTCGTTCCTGCCTCACCCGCCCCCACCCCGCACGCCCAGCCACACGCACAGCAGCGGCAAGCACAGACCCCG
CTGTCAGGGACAGCCCTGAAGAGGAACCGTCCCTAGAGCCCGTCCTGCAGCTGCTCCACACTTCCCCGCCCCACGCAC
CCCCGTCCCACCGCCCAGCGGACCCTGGCTCACCCCGCGGATGTTCCAGTACCCCAGTGTCATGGGCATGGTGCTGGTT
GCTGTGGATTCTGCAGACAGGCCTCAGCGGGGCGGGGCTCAGCGTTTGTGAGAGGCCAGAGAGGGTAGAGGGGAAGCC
TTGCTGCGACCCCGCCCCACGGCCCGCCCTGCCCCCGAAACGGGCCAATCTGGAGGCCTGGAGCGCGCTCATGGGGCTA
GGAGTAGGATCTCCTCCCACCTCCCAGCCCCGTGGGTTTCAGGAGAGAGATCAGGACGCCCAGAAGCCCAGGGCGGGGG
AGAACTGGTTGAGTCCAGGGGTTCAAGACTGAACTGAGCTATGATCGCGCCGCTGCACTCTAGGTTAGGCAAGAAAGAA
AGGCTCTCTCTAAAACAGAGAGATTCTGAATAAAGTAATAATAGCCTAATAAAGAAAAATAACACAAAAGAACATTTGG
TGCTCAGGGATTCACTGGATAAGTTTTCAAAACTTTTCAATGTATGATAGAGATTGTTATAAACTGCGGACATACGTGG
CATGACAGACCTAACGTGGGAAGGACAACACAGGCAAGGATGATTATAACTCACTGTCACTTATCAGCCTAAATCCAAA
CGTCAGGAATACCGCCTCAGAGAAAAGAAAATGATGTTTTTGTCATAAGTGGTGCTGTGCTCCTAGGGAGCTTGCTGGG
TGGGAAGAGAGACAGAAAGGTGGGGAGCAGGGGCTGGTGGACTTGGGGAGGGAGGAGAAAGCCCATGTGGAAACGTTAG
AATCTGGGGTAATCAGAGGTCTTTGTATTCATTCGTTTTGTAAATTTCTCAAACTCTCATGTTAAATCAAAATAAAAAG
TTAAAAAAAAAAACTACCAGGACAGACATACACAAATATTATTAACTGAAATAAATGTTCCATCAAAAAGGACTTACC
TTAACTACATGAGTTATATATGATTTCTATTATTATTATTATTATTTTAATATTAGTATCCATCCAGCACACCAC
TGGTCTTCAAGTGGAGGTAACTTTGCCCCTCAGGGGACATGT

SEQ ID:82
>T14
ATCAGCCCCCACATGCCCAGCCCTGTGCTCAGCTCTGCAGCGGGGCATGGTGGGCAGAGACACAGAGGCCAAGGCCCTG
CTTCGGGGACGGTGGGCCTGGGATGAGCATGGCCTTGGCCTTCGCCGAGAGTNCTCTTGTGAAGGAGGGGTCAGGAGGG
GCTGCTGCAGCTGGGGAGGAGGGCGATGGCACTGTGGCANGAAGTGAANTAGTGTGGGTGCCTNGCACCCCAGGCACGG
CCAGCCTGGGGTATGGACCCGGGGCCNTCTGTTCTAGAGCAGGAAGGTATGGTGAGGACCTCAAAAGGACAGCCACTGG
AGAGCTCCAGGCAGAGGNACTTGAGACGCCCTGGGGCCATCCTGTCTCTTTTCTGGGTCTGTGTGCTCTGGGCCTGGGC
CCTTCCTCTGCTCCCCGGGCTTGGAGAGGGCTGGCCTTGCCTCGTGCAAAGGACCACTCTAGACTGGTACCAAGTCTG
GCCCATGGCCTCCTGTGGGTGCAGGCCTGTGCGGGTGACCTGAGAGCCAGGGCTGGCAGGTCAGAGTCAGGAGAGGGAT
GGCAGTGGATGCCCTGTGCAGGATCTGCCTAATCATGGTGAGGCTGAAGGAATCCAAAGTGGGCATGCACTCTGCACTC
ATTTCTTTATTCATGTGTGCCCATCCCAACAAGCAGGGAGCCTGGCCAGGAGGGCCCCTGGGAAGGCACTGATGGGC
TGTGTTCCATTTAGGAAGGATGGACGGTTGTGAGACGGGTAAGTCAGAACGGGCTGCCCACCTCGGCCGAGAGGGCCCC
GTGGTGGGTTGGCACCATCTGGGCCTGGAGAGCTGCTCAGGAGGCTCTCTAGGGCTGGGTGACCAGGNCTGGGGTACAG
TAGCCATGGGAGCAGGTGCTTACCTGGGGCTGTCCCTGAGCAGGGGCTGCATTGGGTGCTCTGTGAGCACACACTTCTC
TATTCACCTGAGTCCCNCTGAGTGATGAGNACACCCTTGTTTTGCAGATGAATCTGAGCATGGAGATGTTAAGTGGCTT
GCCTGAGCCACACAGCAGATGGATGGTGTAGCTGGGACCTGAGGGCAGGCAGTCCCAGCCCGAGGACTTCCCAAGGTTG
TGGCAAACTCTGACAGCATGACCCCAGGGAACACCCATCTCAGCTCTGGTCAGACACTGCGGAGTTGTGTTGTAACCCA

FIG. 26 (CONT)

CACAGCTGGAGACAGCCACCCTAGCCCCACCCTTATCCTCTCCCAAAGGAACCTGCCCTTTCCCTTCATTTTCCTCTTA
CTGCATTGAGGGACCACACAGTGTGGCAGAAGGAACATGGGTTCAGGACCCAGATGGACTTGCTTCACAGTGCAGCCCT
CCTGTCCTCTTGCAGAGTGCGTCTTCCACTGTGAAGTTGGGACAGTCACACCAACTCAATACTGCTGGGCCCGTCACAC
GGTGGGCAGGCAACGGATGGCAGTCACTGGCTGTGGGTCTGCAGAGGTGGGATCCAAGCT

SEQ ID:83
>T17
GGCGCCACTACGGGATTAAGCCTGAAACCCGAGCGGCCCCGGCCCCGCCACGGCCGCCTCCACCACCTCCTCCTCCTC
CACTTCCTTATCCTCCTCCTCCAAACGGACTGAGTGCTCCGTGGCCCGGGAGTCCCAGGGGAGCAGCGGCCCCGAGTTC
TCGTGCAACTCGTTCCTGCAGGAGAACGCGGCAGCGGCGACGGGGGGAACCGGGCCTGGGGCAGGGATCGGGGCCGCGA
CTGGGACGGGCGGCTCGTCGGAGCCCTCAGCTTGCAGCGACCACCCGATCCCAGGCTGTTCGCTGAAGGAGGAGGAGAA
GCAGCATTCGCAGCCGCAGCAGCAGCAACTTGACCCAAGTAAGTGCAAAAGAAATTGCCCCCTGATTTATTGCTGAAAC
CTGTAAGGCTCGAATGTGCAAAACTGATAGTTTTACTAACCTATAAAAACGTCTAGACGCCTACCCAAGCCTAGGCGAA
CAACATGCATCCATAAAAAGAGCTTCCCATAACCACCTACCCTGGGCGCTCAGTTAGTACGGTAAACAGAGCGCGAGCA
TTAAGGCTTTTTATGATAATTCCCCACAAGTTGTGAAAAGCGACCATCCTTGGTGAAATTAATTTAACGACCTCTCTTC
CCCACCCTGTGGTCTCTCCCTGCCTCCCCTCCTCTCCTCTCTCCCCGTCTCCAAACCTCCCTCTTTGTAGACAACCCCG
CCGCGAACTGGATCCACGCTCGCTCCACCCGGAAAAAGCGCTGTCCCTACACCAAATACCAGACGCTTGAGCTGGAGAA
AGAATTCCTCTTCAACATGTACCTCACCCGGGACCGGCGCTACGAGGTGGCCAGGATTCTCAACCTAACAGAGAGACAG
GTCAAAATCTGGTTTCAGAACCGTAGGATGAAAATGAAAAAGATGAGCAAGGAGAAATGCCCCAAAGGAGACTGACCCG
GCGCGGTGCTGGCGGGAGCGCTCAAGGGCAGCGGATTTGTTGTTGTTGCTGTTTTCCTTTGTGGGTGTTTGGTGCTTGA
TTTCCAGAAACTCTCCAGCGACTTGGACTTCTTCTTCTTTTTTTTTTTCTTTTTAGATAGAAGTGACTGTGTGGTTGGT
CTCTGAGGTATTTGGGGGACTCTGTATTTGCTCGTTTACGTGTTGGAAAAACCAAGTGGCTTTGGGGTTTCGCCCTATC
CCACTCCCTCTCTTTCCTGCTCCATTGGTTCCTTAAGAAATGCTATATTTTGTGAGTGCAAGCTGGCTTGGGGAGCCCT
CTCTTGTGTAAATGTCCCCCATGTTTCTGAAAAGTGCTGTAGTTTAGTCCCCTCACCCCCAGCACTGCCCAAACAGGGG
CCAAGTGCGCCCCAATTCCAAGAATGAAGGCAGAGCGACAACAGTGCGGACACCCCGGCTGCTAGCCCACGGTGAAGCC
CGGCGGGGTTGCCCACCAGTTGCGAAAGCCCCCTTTCCTCAGGGAGCACGCGGGACCTCGGTGGAGATCTCCAGTGAGG
CTTAGAGGAGCCCAGGGCCTCGGGCGGGTTGGGGTTTGTCCTCAGTGCATTGGACGCGCTGCTCTCTCCCCTGAAGGCT
GGGCTCGCGTGGGCGGCCGCGGGTGGTGGCCCTCCCGGTTCCTGCCCGAGGACCAGTTGTAAATGTTACTGCTTCCTAC
TAATAAATGCTGACCTGATCA

SEQ ID:84
>T18
GATCATCTACTAGGTTGAAAGGAGAGAATATGACTTCCAGAACAGCACTGATGCTTAAAAAGGATGCCTCTGGAAGAAA
AGGAGGAAGAGGAGCAAGTGATGGGAGAATACAGTGGGACTTTGGGCACCATAGGGTCATCCTGAGTTTTTCACCAAAA
TCAGGAACAGCGGCAAAACTGGTTTCACTGAAGAAGACACACGTTTGGAGACATGTGTAGTCTCCAAGGATTCTCACTT
AACAAAGCCTATTTCTGTTGTTAAAAACCCCTGCATAATGCACCCACACACAAACACAAGGCTTGGTCTGTGTTCCTGG
CCACCTAAAGAAACTGATTCCCAGTAAGTTTAAACCTGAATGAAATGTTTCTGCAAATTCAGCCTCAAAATTCCTCCTC
TACCTGGCATCCCTGGCTTGTAAACTATGTGTCTCATTAGTTCATAAACAAAGCAGCCCTGACTTTGCCTTGTACTCAA
CCACAGCCCTAGGAGCCAGTAGAATTTGTCCAGAGGTGCTGGGCTTTGGAGCCCAAGTGGACAAAGTCAGACCCCCTTT
CCTCAGGGCAAAGCCCTCCCACAGGGCTGGGACCCCAAAGGCTATGCTGGAAGCAGGTTCAGCAGCAGGATATCAAGGG
GCAAAGCTCCTAATTCAAAATCTTCCTGGCTTCTGAACAACCATTACCATGGACAGAGAAACTTTTGCCCTGCTCTGA
GAGCGTCCCACAGGGCTTTTGGAAGCAGAGCCACCATTGAGAAATCCCTTTCAACCTGAGTAGTAATTCAGATTTTTCT
CCCACTCCTGCACAACTTAATTTGCTGAATGGAAAATTCAGCCAGAAGTGATGGGCTGCTTGAAATCAACAAAACTTGA
CACATTCTTCCCATTTTCATTTTACTTTATTGTTAAACACATAATTGATC

SEQ ID:85
>STAR A1
GATCAATAGAAGAATGGAGTTTGTGTTTGCTAGCCATAGTTTTGACGTGTGGGAGAGTTGGAGTCTAGAAGGTTCTCTG
GACGAATGTCGGCTTGTTAACTGCAGGAATTCCTCTGTAAGTCTCTGTCCTTACACAAAATGGCCCGAAATTGAAAAAC
CCTACTTCTTGGAAAACAGAAATAATTTGTGTAATGAATGTTGCAGGCGGTGTTGGACGTTCGTGTGGAGATATTGGCA
ATGGTAGGAGACGATGGTATCACACGTTGGATCGATTAAAAAGAAAAACAGAGTCTCTCCATTTGTGAGTTTCTCTCTT
TTAATTACTTTTGTTACTTTAACATCCTTAGGATTCACAGACGAAAACAGAGACACCCAATTTTTGTGTTTCGAGACT
GTGTCGTGTGTTGTGTAGTTGGTATCAACCAACTTATATCTGTAATCATTGTTTCTTTTATTTATTCTCGGTTTGCAG
AAACATCCGATGAGCTTGTCTTAGAGGGACGTTTGTTGTTGTTTTCTGGGTCTGGTCGTGATGAACTCGAAAGCATTGT
GTGTTTGGTTAGTAGTTTGAAATAGGTGTGTGTATTGTATTTGTATATGCTGCGTTTGTGTTTTAGAGATCATCGTACA
TAAAACACATCATCGTACATAACTAAAATTTGAGCTAAACTACAAAAGAAAGTAACCTTCATTTTTAGTCGAACCAGGC
CCCAGCTAGGCAGCTATCTCGTAAATAAGATTGCTGGCTTACGATCGTATTCCACGTGGCAATTTATGTGCCGTGGATT
TAAATTTGTACGTGGCATGAGTGTTAGGAGAATGTCCACATGGCTTGTAGTTGTTAGTCCCACGCTCTGAACCAGAGCA
ACCGGCTCCTTACACGTGTTCGGCTTAAATCCATTTTTCGAATGAGATTACACTTCTAACCTTGTCTCCCTCTCCCGCT
TATACCACCACCACTCTCACACAAGTCTCTCAAGTCACAAACTCTGTTTCAAACCAAAAGGGAACTTTGTGTGTGTTGT
CGAGTTTTATGGTGACTGTAAACCCTAGCCAAGCTCATTGTTTGCCTATGAAAATGAGTCTACCGGGTTTCAATACTCT
TCCCCACACGGCAACAACGATACCGGTTTCCATACGGAGCAATAGGACGATGTCGTTTTTTGAGGATC

FIG. 26 (CONT)

SEQ ID:86
>STAR A2
GATCAAAATTTTGGTTTCTTCGCTTTGATTTTCTTCTTCTTCTTCTTCTTCTTCCCTCAAGTTCCTTAGAATATCTTTC
TCATCCATTTTTTTTGGTTCTTGTTTTGTTAAGTGAACATTTTAGTTGATTTTAAAGTGCTAAACTTAAATGCAGCATT
TTACTAATATAAAATTACGCTCCATTATTGACCTTATATACATAGAACAAAATAATGTTATAATCTTCGACTTTTTCT
AACAAATATTAACCAATCATGTCACTAAGAAATTAAAAAATACTAGTATATAGGAATCTAGTCCATTGTATATATCGTA
AACATGGACACTTCACCAACGAACATGCATGGGGTCTTTTTATAAGGTTCTTTATACCGAAACCATTGTTTTGGTTTTT
ATGATAATTGAGTTAGTTTTTGTGGCTTTTCCGTTCAACTAAAAGTCTCATTATGTCAACTGCTATTAAACCGGCGCACA
TGGCATGTTTTATGAAATTAAGGTCAATTGGACTCCAACTTTTCAATTATTAAAAAAAAAGAAAAATGATTGTTGTATG
CCTTGGCGAAGAAGAAAAGCCGCTAGCTTTATTCATTATCAAACGAAACAAAAACAACAACACATCACTAAGAATCTTA
AACTCTTAACCTTACATCAAAGTAACTTTTATTACATTGCATACAAGAAAAGAACAAACCAGCATTATTAGGTTTGAGA
TTAAACCTGTTCCCACACATATACATAGAGATATGAACTCTACAATTTCAAACCAGAGCCTTGAAGTTTCTCCTCAACA
ATCATGTCGATTTTGTTTTCCATTTCAGGAGTCATATAACTCTTCCAATCACCAACTTCCCCTTTACGGAAAAAACTCT
TGAAACTTACTCCTTCCGACAAGCTTCCTGTTTTGTTGATC

SEQ ID:87
>STAR A3
GATCATTAATCGCAGATTTTTACAAGACAGCAGCTTGGAGAGCAACTTACAAGTGTGTTATAAACTCTGAACTCAACTT
GGAAGATGTTGACGTTCCAAATGAAATTGGAAGACAAACTATCTTCCCACCAAGGACAAGAAGGCCGTCTGGGAGGCCA
AAAAGGCTACGTATCAAATCCATTGGCGAATATCCGGTTCGTATTTGTAGGAGTCCCATTTTTTCGACTTTATCTTTAT
TCCGTATTTAATTTTCAATTTTATGTGGTTTAACAGAAATCAAACAGCGTGAAGGTGAAGATTAACAGGTGTGGCAGAT
GCAAAAAGACTGGACACAACAGGACAAGCTGTAGTAATCCAATCTGAAGATGTTTTAAAATCGGCTATATTGATAGAAC
GATGACCATTTTATTATTGTTTTTGTGTTTGGAAATGGTTATTTTTGGATAAAATATGTTGCATTCTATTTTATAATTT
TAGTTTCGACTTATTACATATAAATCTAGTAAGGTAATATATTAGCAAATTACAGATAATGATGAAAAACATGGACAGG
TATAGGTGGATAAGATATAAATAAGGTAGGACTGAATTGTTACCCGTTAATAATGAAAGAATATACGAAATACTAAACA
TTAAATAAGGAAGTTACTAATTATTGGACAACAAAAAGTTTAATTCCTTTAAAAAGAAATTGGAATACAGACAGTTTCA
TTGACCTAATTAAGTACTTCTTTGAAAAAAATCAAACTAGGAGAATAGAAGTTGTAAATAATTGAAGGGAAACGTCGAT
TCGGTGAAAAGGTTTTTTAATTAGTATTTAAAGGGAAATATCTTCTCTTATACAGAATATCTTGCCCCAGAACAAATCG
CCTCAAATACTAAAAGTGTGTACATCTTCTCTTGATC

SEQ ID:88
>STAR A4
GATCAAATTCATATGCTTATTTGTGATTATACTTTGCTTTGATTCAGGAAATCAAAGAAGATAGCTCCACCTTACAGGG
TGATACTACACAATGACAACTTCAACAAGAGGGAATATGTGGTTCAGGTGTTGATGAAGCTAATACCCGGCATGACTGT
AGACAACGCGGTTAACATTATGCAAGAAGCTCATATCAACGGTTTGGCAGTTGTGATTGTTTGTGCTCAGGCTGATGCA
GAGCAACACTGTATGCAGCTGCGCGGTAACGGCCTTCTCAGTTCTGTTGAACCTGATGGTGGAGGCTGCTGAAACTAAT
TAAACTCAGTATAGATTTTCCCACCTTCCAGGACTCTCTATTTAGTCAAAAACATTTGTTGTTTTAATGTATATAATAT
CAGAAATTTGGTACAAGACTGTTACTATATGCAATGAACCTTGCCCCTACATAGATCTGTTGTGAGTTTTAAGTGTTTT
CATTTGGAACTTCAGAATGCAAATAAACAAAACTTTATTGAAGTCAAATGGTGTTACAGATGAATCTTTCTGATTCTGT
AATCACTAATGTAAATGTATCTAAGCAATTGTAAGGGAGTGACGTGTTTCGGTTTCATCTCGCCCAAAAAAGCATTCAA
ACCCAAGAAACCTGCAGTTTCAAGACATTGATGGGATACCATATAGATGTATCAAGCATCAACCGGAGTAAGAAGCGAC
TGAATGCCGAAGATAATGAAAAGCATTCCACCGGAAAGAGCCACCTGCAACAACATAAGAGCTATTTGATC

SEQ ID:89
>STAR A5
GATCCTGTAAAACATAAAGTTAGAGATAATTGTCCGATTTGTTTGCCCTTTTAATTTGGAGAGATATGAACCAAAAACA
TATTTCGGAATGGGTCCCTTTTTCATCGTGTGTAACAGTTTTACCAAACAGTAATACTTTGTGAAAGTTTTGATTAATT
AATGCAAAAGATTAGAAAAAAGCGAAACTAATTTTTGGATTACACTAGAAAAAGGTTAAAATCAATAACCAAAAAAAG
AAAAAGGTTAAAGTTACAAAACACACCGGTTTATAGAGTGAAATGATTATTGTTCTGTTGAATTGACGTGCCAGCTTAG
CATCACCTTACTATTATCAGTCACCTATATATCACAATTCACAGGCTTCTTGCTTTCTCTCATTGGCTCGTCTTCTTCC
CTTTCTTCTCCAATCACCTTAGCTTGCTGATCAGGTAAACTAGATTGGTGTTTCGTGTTGTTTTCTTCTCAACTTAGGT
GTTTGATTTGAAGAGTTTTTCTATGTATGTTGGCATGTTGCGTTCGTAGCATTGCATATCAACGGATAGGTTTGAATAG
GTAGAATTAATTTGATTGATATATGAAAGAATGTTTGTATATATACTCTAGGTCTAGGTTATTGAATATTGAGAAATTT
ATTTTGTTAGGTTTAGATGAATTATTCTTCGATGAGTGGTTCAAAGTTCAATTGGCAAGTCTTTTCAATGATTGTAGTA
TTTTGGTGATGATAAGTAAGTTGTTAATGACTCTCAAGTCTGAATTCATGTTTTGGTTTTGTTTCCTTGTAAAAATGTG
AACGTTTTTCTTACAGAAGCTTTCACAAACAAAGTATGGTTAATTGAGTGACTAATCCACTAATTCTCTTTTCTTGTTT
TATATCGTTTATTAGGTAATGTTTTTTTTTTTGGGTGTGTAAAATATGATACTGACTCAAGATTTTATCATATTTCTG
AATCCATAAGCTAAAGTCACATTTGAGAGAAGCAAGAGAGATAGAATGGGGCGTGGAGTTAGTGCAGGTGGAGGACAAAG
TTCTTTGGGATATCTTTTTGGGAGCGGAGAGGCTCCAAAGCTAGCAGCCGTTAACAAAACTCCAGCTGAAACTGAGTCT
TCTGCTCATGCTCCACCTACTCAAGCTGCTGCTGCAAACGCTGTTGATAGCATCAAACAAGTTCCTGCTGGTCTCAATA
GCAACTCTGCAAACAATTACATGCGTGCAGAAGGACAAAACACAGGCAATTTCATCACGGTATGTCTTTAATTCTTTCG
CTGAATCGAGTCCTGTGTGCTGGTTATCGGATAGCAAAAACATCTGTATCTTTACTTTTCTTAGATTAGTTGTCTGAAA
ATGAAAGAAGATC

FIG. 26 (CONT)

SEQ ID:90
>STAR A6
GATCGACTGGTACAATGCTAGAAGCCCTAGAGGTTGTAGGTGATAGCCACGATACATCCTTAGGTGATGTAAGTCAACT
GAATATAAATGGCCATTTACGTAGACTTCATGTCCTAGATGATCCCTCCTATTATAACGTGAATCTCGGTTTCTTGGTG
TGGAAAACGAAATGATTGATATGTTTTTGTCAGGGATTTGAGGTGGTGAACAGTCGTTATATGACTAGTTATGATGATG
AAGATACACCGCCAGGAAGTGGATTCAGGACAAAACTAAGAGAGTTCCATAAGAGGTAAATGACGCATTAACTCATGCC
TCTCAACATTTTGTCGGCATTCAAACAGATGCATTCAAGTCTCTTTTAATAAACACAAGAATCCCATTTGTTTATTGTT
TTGTTTGTATGCAGTGCGGCATCATTCACAGAACTAGATAGGAATTACCTAACACCGTTCTTCACAAGTAACAACGGAG
ATTATGATGATGAGGGTAACATGGAGCAACACCATGGTAACAACATAATTCTCTGATCTCTTGTTTCACTATTATTTTT
GTTGTTATTCCGCACCCAAAACCATGAAATTTACAATTGGGTTATTGCAGAAGAACGAATCCCATTTACTAGAAGAGG
AAATCTAAATAACCGCGGCTAAGTTTCCGAGATGAGAAATCTAATAGTGTTTTTTCAGCGGCATATATATGTACATAAA
ACAAACTGATGTATGGGAGGAGGTAGTGACAAAGGATTTGTTCTAAGCTAGGTTTCTCTATAATATGGTACTGTGTTG
TTGGTGTAAACCTGAATGGATATTGTTAGGTTGAAACTAATTACATTCACACAAAGAAAGAAAAAAACTTGAAGAAGGC
CATGGCTGGTTTATACTGAACCACGAATTTTGTTAGTTTTAAACTCTTAGGGAAAATGCTATAATGCCTTTTTTGTCTT
GTAGTCGTGTTTGGTTTGAATTAAAAAAAAAATAGAGAACGTCACGGCACGCCAAAAGTGTGGACCTTGTTATTCGCC
GGAAGTAAGTAACCAAAAACGCTTCTAATCTTTCGTTTACAACAAATATCTCTCTCTCTCGCTCTCTCGCTCTCT
CTTTCTTCTTCTTCATCTTCTTTCATGGCTGTTACTGGCTGGGCAATCACAATCTGAATTCTTTCTTCCTCCTTGTCTC
TCTGATTTTCGCCGAGTTTTGGGGGCTCTTGTTGTTACACGATGAGTCTGGTGGTTGGTCAGTCTCTGGGTTTAACTCT
AGTCGGTGATGGTCTTTCGTTACGCAATTCCAAAATAAATGTCGGAAAATCAAAGTTTTTCTCGGTAAATCGGAGGAGA
TTGGCGCGTGCGGCCCTGGTACAAGCTAGGCCTAAGGAAGACGGAGCGGCGGCAAGTCCTTCCCCATCGTCGAGACCGG
CGTCAGTTGTGCAGTACCGACGAGCTGATC

SEQ ID:91
>STAR A7
GATCTATCTTATATTGTTAGTTCATGTTTGTTTTTAAAGACTGTTTTTATGTTTCAATGGTATATTACTGACTGGGGCA
GTAATATTGTTGAAGTCTGTAGATTATGGTCGCATGGCTGAAATACTGGTGCAGAGGGCTGCTTCTCCTGATGAATTCA
CTCGATTAACAGCCATCACGTGGGTAAGCAGAATAAACCATGCTTCTGCTTGGCGTCTTCCAGTTATATAGATTGGTAC
TATTTTGACTTCTCGGGAGATTCATATACTAAGAATATCTGCTTTTTATTAAATGTTGTAGATAAACGAGTTCGTAAAA
CTTGGGGGAGACCAGCTCGTGCGTTATTATGCTGACATTCTTGGGGCTATCTTGCCTTGCATATCTGACAAAGAAGAGA
AAATCAGGGTGGTAAGTTTGCTTCTCCTCCTCAGTGATGGAAACTGTAGGTTTTGTATGCATCTTTTTACTTTCTTTGT
TTTTTGATTTTTATTTGCATAAGGTTGCTCGTGAAACCAATGAAGAACTTCGTTCAATCCATGTTGAACCCTCAGATGG
TTTTGATGTTGGCGCAATTCTCTCTGTTGCAAGGAGGTTAGTTTTTCTCTATTGTTGTTTTTATATCCGTTTGAATATT
ATTAAATCGCGCCTGTTTATTTGTGAGTTTTTGCATTGAGCAGGCAGCTATCAAGTGAGTTTGAGGCTACTCGGATTGA
AGCATTGAATTGGATATCAACACTTTTAAACAAGCATCGTACTGAGGTGAAGAAACTGGTTTTTGCTTGGGCATCATTC
TTTTCTAGTTAGCCTTTTTGTTTATCGCGTTATAGCTAAATTGGTAATGCTGCAACAGGTCTTGTGCTTCCTGAATGAC
ATATTTGACACCCTTCTAAAAGCACTATCTGATTCTTCTGATGACGTAAGTTCTATCTCCCTGACTGTTCGTTTGATTG
GTTGGTGAACTTTATAATATAAAGGTTTGGTTTTGTCTAGTAATAAACTTATTTGATATTTGAACTATCTGGACTTGGA
AATATACTTTAGGTGGTGCTCTTGGTTCTGGAGGTTCATGCTGGTGTAGCAAAAGATC

SEQ ID:92
>STAR A8
GATCATCTTTTTCTAGGTAGGGAATTGCTTATCTCGGTAAGCTAAGAATGTTAGAAACAAAGAACTAGGACAGAACGGG
AAATGGAGAAGGAGGTTAGAATCAAAGAACAGTAAATGGAGAAGGAGGTTAATGTGTATTTCATTCTATCTACATTTTA
ACTAATTGAGTGTATCCAGTCTTATCCATTAATGTAATTACAAGAAGAATAGTACCAAGCATGTAGGTTATAGTTTTCA
CTTTACTGGGTGAAGGTTTCTGTAGTTCAAGTGGGTCAAAAGTGGTTTGCGGAAACATATCTCTAATAATTTGATTGAG
AGGCTCCTCGCACTCACATGGACTTAAACTTTTGTGTATTATACAAACATGATTCACATACACATCTCGTGTATATTGC
AATACATTTGGTAAATTATCTGAAAATAATAATGAAGGTTTCTTCAAAAGAGGTCCAGGAGCTATTTCCATTAACACTG
TTATACTGAACAGTATACAAAAGAAGACTGCAGTGCGAGAATTTATGGAGGATGATAATGCATTTGAGATATTCTTCTG
AACACTTTCATATCTTTTATGTAAAACATTTTTGATGAGAAAATCACCAGTAGTATCCAAACACTTTAATCCAGATGAT
GGGAAAATGCTTTGTTTAAACCTACTACGAAGTATGCTTAATACTTCATTATTACCAGTTGATC

SEQ ID:93
>STAR A9
GATCTGGTTTCGGTAATTGTTGTTTCCGGGAATTGAGTATAGAAACACAAATACATATTTAACCCTGATGAAAGAGGGT
GTAAACTTGTGCAGATAGATGCGAAAACAACGCACGACAAACTTGTGAAGTTGGTGCTCGATGATAAAGTTAGACGAAA
TGTTGTATCTCTTATTGTTTTGCGACAAATTTACATGTCACGGCTGAGTTATATGCTTAAGGGAAGATGAAAAGTTCAG
TCAATTTACATGTCACCACTGAGTTATACGTTCCAGGAAAGACGAAAGGTTCGATAGAATTACATTACGGTTGAGTTAT
ATGCTTAAGGGAGAACGAAACGTTCAGTCAATTTACATGTCAGGCTGAGTTATATGTTCCAGGGAAGACGAAAGGTTC
GGTAAAATTACATTACGGATGAGTTATATGTTTAAGGGAAGACATCTATAAATTTACATGTCACGGCTGAGTTATATGT
TCAAGGGCAAACGAAAGATGAGTGTAAATTATATGTTACGGCTGAGTTATATGCTTCAAGGAAGACGAAAGGTTCGGTA
AATTACATGTCACGGCTGAGTTATCATTCAGGGAAGACGAAAGGTTGTGTAAATTATATGTTACGGCTGAGGTACATCA
CGTTAAGGCTGAGTTATAATACAGATCGGAAAACAACATTTTTCTCGGCGAAGACAATATGAAATTTATTGGCCAAAGAA

FIG. 26 (CONT)

```
CAACAATCAAATTAAGAAACGTAAGAATATGTTTGAGGGATACATAGGAGGAAGACGAAACTATATGAATCAAAACATT
GATAGAAGTAGAAATATCTCTAAATAGATCGATTGAGAGGAAAACTAAACGAGAGACATATAAAATCAAAGTAAAAGAG
TAGTTATTCTTGATTCAACTCAAACCTGTAACAAATCATATAAAATTCTATAGATC

SEQ ID:94
>STAR A10
GATCTGAATGAGATGTGTTGGCGAACGCATATAGTTTTTGTTTCTTGCTGTTCATAACTTTGCTTATGGAATTTTATTT
ATGTCTTTCTCTATACCTCTTTGGACCAGTGTTCCATTTGCAATAGAGAGTCACTCGTGAAAAAAACAAATAATGTGTG
TGTATCAATTATTCCCTCTCGGCCTTATATTTTGTCTTCTTTTTGCTAATTATATACTATTGATTTAGATATTTACTTA
TATTCATGACGTCTTCTTCTTATATTCTTATTTAATTTGAAGTTAGAAAATTAACGTTACAACTTACAACTATTAAATT
ATTGTTAATTGGTTTTATAATAAGTATCGCTCTTGTCTCCATTCACTTGTCTTTTATTGTCCCCAGTACCAAACTACCA
AATACAATTCATATTCACTAATTAATTAGTTTGATGCAAAGGATGATGCAATGTTAAGAAAATTGAAACTCTACCACAT
TCTAAAATGAAGCAACTCTACCATATTTAATTTCTTTAGACTTGGAATAGTCACAATATGAATGCTTAGGTAGTTACGG
TTAGTTAGGAGTATCACACAGAATTGAAAATACCAAACCACAATTTTAATCAGGTGATTCGGTACTAATTTTTATTAAT
GAATAAAAACATAACCGAACCAACTCAAAGCAGATATTAACCTGAAAATGAACTCACCAAAACAATAATAGAAAGACTC
AAATCGAGCCGGAAACCAGATTGAGCAACGAACTCATGGGAATATCATATCTATTTATGTCCAGACTATTAATATACAT
ACCTATGACAAAATACTATGCATGCAATGCAAGACTGAAGTAACCATATTTTTTGGGTAAACCATTGATAAGCTAAAC
TTGAATATCCATAGTACTTCATCGTACTATGTATCAATAGTATAGTAAGTTTGACACAATTACATTCAGTTTGATTTTT
ATCATATAAACCTCCCAACAATATTTAAAACCGTATCTATATATAAATTTATTTGATTAAATCAGCCTAGAAGTTTATA
GTTCAGTGCAGATAAATTCAAATTTTGATATATATCTTAATTGAATTAACCGTCTTTTGGTTAAATTATTGTTACAAGC
TTACAAAATCCACTATACACCAAGTTGGACTTAGATATCATATATGAGATTAACAGCCGATTACACTTGTACATTGACC
TGACCTATACAAACGACTACAACTTTATGTATATATATTTCTCTATTTTTGGAAACTCGTTTGATTTGTTTTCACATGT
CGTGAAATTTACAGCTTTGTTTCCTACTCTCAAAAATAGAGCATAGAGCTGGCTGATCACACTTCAAATTAAAACCAAC
AACGTATATAAACTATAACCCATGTGAACACAAAAATTTAGACCTTTTTTCAAAACCATTCCAATTTCTAACAAAAACA
AAATTAGAAATCCTAAAATCTGCAAGGTGTATGGAAGGCAAAAAAGGCTAACAGGATTAAAAACAGTTTACATTAGTTA
TTCTCTTTAAAATAGAAAGAAGATTTTCGATAAAAACGTCGTCGTATCTTCGTCGACGTCTCCGTCTTTAATGGGGGAG
CAAAGGGCAAGCGGTGCTTCCTCCTCCACCGACTCATATTCAACTCCTTCGCCGTCTGCGTCACCGTCTCCATCTCCGG
CTCCACGTCAACATGTCACGTTACTCGAACCATCTCATCAACACAAGAAGAAAAGCAAAAAAGTCTTCCGAGTTTTTCG
TTCGGTTTTCCGATC

SEQ ID:95
>STAR A11
GATCTCACTCAAGCTCATGCTCACGTTCAAGGACTTTCCAACCGCAAGGTTATCTTCAACTTGTACTCATTAAGGCCTC
TCAATATTCATGTGTTATGTTCATGTAGATGTCCGGTCCAGTTCAACAACTGTTTCATTGCTTTAGTTGTCACGAGAAA
TATTTGTATATATTATTATGGTGTGCAAAACATAGTAAAATGTTGTTCAATTGGCAGATGATGATGATGAAAATGGAAA
GTGAATGGGTTGGAGCAAATGGAGAAGCAGAGAAGGCAAAGACGAAGGGTTTAGGACTACATGAAGAGTTAAGGACTGT
TCCTTCGGGACCTGACCCGTTGCACCATCATGTGAACCCACCAAGACAGCCAAGAAACAACTTTCAGCTCCCTTGACCT
AATCTCTTGTTGCTTTAAATTATTTCATATTGTAAATTACTTTCTGCTTTATCGGTTTTACCATTTCGGGAGTCTTTTT
TGTGTGCAATCTGTTTCGTTTGGTAAGCTTGTAGTTTCATGAAAGTGAATGTAAGATATGCATTACGTTTGTTGCTGAA
GTGAATGTAAGATACGCACTATTATATCTCATGATTTTCTAAGAAAACCCTCTTAAAACGAAGATGTCTATAGCATTAC
GTTTCTATTTCCATATAATACGTTAAAATTTATGGTTTTTACGTATAAAATGCAAAATAAAGACACAAGTATATCTCCA
AAGCAATGTACCGTTGGGAAAATTTATTAGTACGTTTTCAATTGTCAATGCAAATAATTAATGGATGTGATAGTCACAA
TTAAACATACAATAATAAAAATGATGATGATGATTCGATGATGTGGTGGGAAGGATAAATTAAACCGACTTTGGGGCAG
TGACAGGCAGTGTCAGTGTCAAAGACAACCATTTGTAGTCACTATTTCTATCGAAGGTTGCAAATTGAATGGTGGAGGA
GTATCAAAACGACACACATACTTGAAAAGATATTTTAATAATATAAAAAAATTGGTGATGGCGTAATAACAAACCTAGA
GCTAATTATTATCCTTAATGATACCAAATCTATATGATACGATATTTGTTTTAAAAAGAGTAAAGACTGACACTTGAGA
TGTGACACTGGCGATTTCGCTCACGTCACCACTTTTCCCACCTCAAATAACGCTTACGGCTTTATCCATTAATTCTAAG
TATAATTTTAAGTGTATTTTTTCTTGCCAAATTCAAATATATCTTACTAAATGGATGAACATTATAAAATTGTTATCAA
AACCATTAAATGTTCTTATATTTCTTTCGTTCCTCCAATGTCATCCCAAGACTTTTTGACCTAATATATGATATATCT
AACTTGCTTTGGAATCGTATGACATATATCTTCAAATACATATTTCGTATTTTTTTTTCACGAAAACTAATTTAGAAAG
TAGAAAACCAGCTATTTTAAAGAAAATAAAGTGTGTTTATATATATTCTAAAACAATGCTATAAGAACATAAGACCAAG
ATATATACAATGTTATTTTATATTTATTATTAAGCATTAACATTGAAATTAAAAATATTAAACATGTATACCAAAGTAA
TCAACATTGTAGTTATTACTACTCTCTGTTCATTTTGTTTGATTGTTTAGAAAAAACACACATATTAAGAAAACAT
ATTAAATATTGATTATAAATGTATTATTTTAATGTTTTACAGTTTTCTATAACTTTAAACCAATGATAATTAACTATT
TTTTTAAAAAATTACCATTCACCTATACTAACCAATAAAGATTACATAGAAAACTAAAAAAATTAATCTTTTAAAAACA
AATTTTTTTTCTAAACAATCAAACAAAAGGAACAGAGGGGGAATATTATTTTAATTTAATTTAGATTACCATTGTAGT
TAGTAATTGATC

SEQ ID:96
>STAR A12
GATCTATTGCTGTTTATGGCAGGCTGTCATTTCAGAAAAGAATGGTGGTTTGGGATGTAATGTTGGTGAAGATGGTGGT
CTTGCTCCAGATATCTCGAGGTACATATATTTTTCCTCTCTGATGCTAATCTGCTTGCATCTGTAGATTGTCGAAACTG
AGAAAACCATGTTATGGTTTGATGGCTTAGTGCCTAATATGTGTAATTGCAACTGTATGCAGCCTCAAGGAAGGTTTGG
```

FIG. 26 (CONT)

```
AGCTTGTAAAAGAAGCTATCAACCGAACAGGGTACAATGATAAGATAAAGATAGCCATTGATATTGCCGCCACTAATTT
TTGTTTAGGTAATTTTCTGCTTCCTGGCTAACTGATTTTTTGCGGCTTCTTGTAGTCATGGATAGTCTTGGTTTGGTTC
TCGGCATTGTCATTCACAATTGGCTAGTGAGACGAATAAGATGTTAAATCATCAAATGTGTAGCCTATCAATATCTTGC
TCTTGCAAGTTTCAACTATGTTATACGTTTTTGTGTATTATTTCTTACCTTGTGGAACTGTTCTTTCCTGAACAGGTAC
CAAGTATGATTTAGATATCAAGTCTCCAAATAAATCTGGGCAAAATTTCAAGTCAGCGGAAGATATGATAGATATGTAC
AAAGAAATTTGTAATGGTATGTCTGGCTCGTCTGAACAATATTTTTTGTGTCTATCTTAGTACTCTTGCAGTATTGTAA
CGACCAGATTCTCTGTTTGGTCTCCTTGTGGGTTTAGATTATCCAATTGTGTCTATAGAAGACCCTTTTGACAAGGAGG
ACTGGGAACACACCAAGTATTTTTCGAGTCTTGGAATATGTCAGGTCCAACTCGGTTCCCCTACTATTAACGGTTCACA
TAGATTTTGTGTTCTTTCAGATCACACTGTCTTCTGATTCTTTTCTCAGAGTCAAATATCTAAAGAGAGAGACCCTTAA
ATCTTCTTGTACAATCATTTTCCTTGTCTAAATTCTCAGTGTTAAACTCTTGTAGGTGGTAGGTGACGATTTGTTGATG
TCAAATTCAAAACGAGTTGAGCGTGCCATACAGGAGTCTTCTTGTAATGCTCTTCTTCTCAAGGTATTTCGTCCGTCCT
ATTTTGTTTATTACTATGTATTACCTGTGCACATATTGTATGTTTACTGCCTAAGAACGACAAAGACATAATGTGCATA
CGGTGATACAGGTGAATCAGATTGGTACAGTAACAGAAGCCATTGAAGTAGTGAAAATGGCAAGGGATGCCCAGTGGGG
TGTGGTGACATCTCATAGATGTGGAGAAACAGAGGACTCTTTCATCTCTGACTTATCTGTGGGTCTCGCAACAGGTGTG
ATTAAAGCTGGTGCTCCTTGCAGAGGAGAACGTACTATGAAGTATAACCAGGTCTGGATC

SEQ ID:97
>STAR A13
GATCCATTTCATATACATATTACCAATTTTGGCTTTTATAGGTTTGTATCCAGAAGGCCTTTTCGTGGCTACGATTAAG
GAAAATACGAAAACAAAAGTGAATTTTACTACTTTTGTAGCATGGTTTATTCTACTTTATATACCTAAGAAATATGAGC
AACAATTACTTCTGTAATGACTTTTTACTACTTCGTAGTTGGTACAAACTACAAAAGATTGTGTTGTTTTTACATGATA
CTTTATAATATCTATATTAATATATTTAGTCGTGTTTAATCAAAAAAGCACCAGTGGTCTAGTGGTAGAATAGTACCCT
GCCACGGTACAGACCCGGGTTCGATTCCCGGCTGGTGCATTGAGCTATGATGATATAGGCTTCAGCATTGGTTGGGTCC
ATTGCATTCTTCTGAACTATCAGTTGATGTATGCCACACCTCTGAGCTCTTCTTTTTTTTCCTCGTCAATTAATTTTT
TAAAGTTTTGTCTGCCTAAAAACTTTCTTCTTTTTGATTAATCATATTAAGCATCTCGGCTATAAAAACCACGGTCTAC
TAACTTAACATGCATTGGACTAGTTTTAGTGGAGAGTGTTCGAGTTAAAATGAGAAGCTCACGATTGCATAACGGAACA
TTTGATTCGCTAGGCATCTCCATTTGTAAAAGTAGCCACTCCAATACAAAATGGTCGATGATGGTGAGTGGGTGAGACA
AACCCACCACCACCTCAAGAAGATATATTTCTCTGGTTAAGAATTTGAATGGTTGACAAAGAAACGGTCACTCTATATA
CTTAGAAAATATAGTCATACATAGACACCATCGGTCTAGTTATAATAATAACCACTGGATTAATGCCCACTGAAAATAA
TTGAGTAGCCAAAACATGAATATAACAATATCCCAATTTACATACAACAACACAAAGGAGGTTTTACACGATTCTATAG
TACAAACTCATAACAACAAAAAATCACACTTTTGTTTAACAGTTGCCTTTATGGCTTTACTACAGTATCTTGTCCAGGG
TTTTCACACATAACAATCACAGTAAATCGTTTCCTTTTCTTTGCATCTTCCATTCCTTTTGTACACGTAACATCTCCGG
CTTCCCGACCATCAGCTAAGAACCAGATGCGATC

SEQ ID:98
>STAR A14
GATCCAGCAACTAAGTCTTATGCTCAAGTGTTTGCTCCCCACCATGGATGGGCTATACGGAAAGCTGTTTCTCTTGGGA
TGTATGCTCTTCCCACAAGGGCTCACCTACTTAATATGCTCAAAGAGGATGGTGAGTTCATCAACTAGTTAATATGCTC
AAAGTGGATGGTGTGTTTGATAAACTAGTAGTTTAAGTAGTCAGATTAGTTTCAAGGTCTTCACAGGATTAGGTACATA
TCACGGCAATATTTGGCCTGTATAAGTCCTGGTATCATAAGAGGAACTCTTTGAGATTCACATTGGTTTTAAGTTCAT
TTGGCAGTAGGATATTAGATTTTGAATTTTCCAATACTATCTCTGTTTGAGATTTCATAAATCGAGTTTCTTCTTCATT
ATGTTCGCTGACGATATTGTTTTTTTCATTTATTTATGAATGTTGTTACAGAGGCGGCGGCTAAGATACATATGCAAAG
CTATGTCAATTCATCGGCACCATTAATCACGTATCTTGATAATCTATTCCTCTCCAAGCAACTCGGTATTGATTGGTGA
AGAGCCTGAAAAAAGGCATAACTATTGTTACTCTTTAGACAAAATAACCTATGTTCTCACATCAAGCTATGTAATGTC
ATAACAACAGCGACGAAATACATTGGAATAAATTGAGTATGTCCTTAATCTGTCGTTTTATCTCTTCTTTTAATAAACA
CAGTTTATCTCATAGTAAGCAGAAGAAGCTTTACACGGGTTGTAGCAACGTATTAAACGGTTTGTTTCAATTTCACTCT
CTTTGGTTTTGAAATTCTAGTATAAACCAAAGTAGTTGGTGCTTCAAGTTGTGTTACTTATTCAACAAAAAATATATT
ATTTTTAATTTTTAATTTTCGTAGGTAAGATTACATAGTAACAAAATGTTAAATTTAACAATGTAAGATTACTATGTAA
ATGCATGGGCACCAGTAATCACGTATCTTGATGATATATATCCCTAATCCAAGCGAGTCGGCATTTATTGGTGAAGAAT
CTCAAGACTCATAGTCATCGCTAGTTAACAATCTTTTTCGGACAAAAGCGTCTTCGTTAAAATTCGGCATTATTAACCT
TTTTGCCCTTTTAAAATCAGAAAATTTCTGTTTTACTGGTATTTTTCTTTGACGATTCAATTTTTTAGTTGTATTATAT
ATATGAAAGAAGCTTAACTCTCTCTCACAGCTTGATATGTCAGTATCTAAAACAAGCAATACATAATTTAATTAATTTA
TCATAAAATATTTATGATTAAAAAGTAAAGAAGATAAAATATTAAAAAGTCAAATGTCTCTTATAATTTAAAAATAAAA
TTAAAAAGGATTGAAAAGTAAAGAAGATAAATATAAAGAAACTATTAGTATCTTATAAATAAATAAATAAACTAAAAAT
TGAAATATAATTATTTTAGTTTTGAATTAAGAAAATATTAAATATAAAAAAATTAAACATAAAGAAACTATATATATC
TTGTAATTAAAAAATTAAAAAAAATGAAAATGAGAAAAAAATATAAACTCTTCATCATATAATTAATGAAATTTAA
AAACTTATTGCTTTTAATTTTTTGTACAATAATTAAGGAAATTTAGAAATTAATTATTAATTTTAGAAGAAAATGTTA
AAATAGTTTAATAGTTTTGATTCACTAAATACATGTGTACATATATGATGGTATGAGGATCAAGAAAGTGCCGTAAAAT
GTAAAACTTCCAATGTTCCTTAGTGAAAAATGTTAACTTTTCTGTTGACAAGACGTGTATATAAACATCACCTATACCG
GAGAAGAAGAAGACACAAAACAAAGTTAAAAAGAAGAAATTTTGGTGCAGTGAATTCGAAGAGCAATATGAAGAATAT
TGGTTACATTATTATAGCCACCTTGTCTTGTTGGTCTCCTCCATCATGGCTCTAGTGGCGAGTTTCTATTGGGCCAAA
CGACATGTCAAATGTTGTGGCGGAGAGGGACTGTCGTCAAAGGATGTGTTCAATTTACTTATCAATTGGTTGCTTTTA
TTCTGCTTTGTGGTTTATTTGCTTATTTGGTATTTTTGGTTTAGATTAGTAACCTAAAGCCATAGCAGATC
```

FIG. 26 (CONT)

SEQ ID:99
>STAR A15
GATCAGCAATTACAGTTGGATGGAAAAAGAGAGACGAGAATGTATCTGCTGCTGGTGACTTTAAGGTAGGCTGAGTACC
AAATTGCATTCTGACTGTTCTTACCTCGACCACCTTTCTTACTTTCCCTAGCTCTAATCTTGCTATTACTAGATTGAAT
CTGGTGGACTCGGAGCATCAGCTCGTTATACTCGTAAACTTTCATCCAAATCTCATGGTCGCATTGTGGGTAGAATCGG
AAGGTATGTTTTATTGACAATCCCGAGCAACCTAATGTATGATGTGCGAGAGGATAGAAATCATTTTTTAAGTTGTCTT
TACATGTGTGGCGCAATCATTGTTCTCATTTTACTTTGGAATTTTTTTTTTAACTTATTCAGCAATGCTCTTGAGATTG
AGCTCGGTGGTGGAAGGCAAATTTCTGACTTCAGTACAGTAAGAATGATGTATACAGTAGGACTCAAGGTAAACTACTC
TTTAAAACTTTCGGAGCCATCTTAGCCATTATGCAATCTGCTTATTTCCGGTACTCTTATACTTTGTTTGTAGGGTATT
TTCTGGAAAGTAGAGCTACACCGTGGTAGCCAAAAGCTGATTGTTCCCGTGAGTGTTACTTTCTTCCTTTCTTTTCTTG
TGGTGTCATGTCTGCTGTCTTCGGATAAGAACCGAACAGATTGTGTCTTAATCTGTGGAGTAGAATATATTAAAAAAGC
ATAAACCAATAGAACCAAAGACCAATCCTAAAAGCCTAGGGATGGATTCTAGAGCATTATCCTTGACTCTCTGAAACCT
TTACCCAACTCAATTATGGACAAAGACAAACATCCGTATTACTCTGGGGAAGTCTTTCACTTTTGACACCTTCATGATG
ATTATCTTTGAAACGTGCAGATTCTACTCTCCCCACATTTAGCTCCAGTATTTGCAACTGGAGCATTCATTGTTCCAAC
ATCTCTTTACTTTTTGTTAAAGGTGAGTGATTGGACCCTCTAAATATAATCTACTTTTGGTCTATTGTTATAAGCTGTT
TACCTTATTAAACATTTTCACTGTTCCACGCAGAAATTTGTGGTGAAGCCATATTTGCTTAAAAGAGAAAAACAAAAGG
CCTTGGAGAATATGGAGAAAACTTGGGGCCAGGTGATTGTTACTTCCGAGTTTGGTAGCCAAGCGAGATTCCTTGTAAT
TGTAGATGATC

SEQ ID:100
>STAR A16
GATCGCTTTCAGTCTATCATGTTTTGAGCCTTATTTTGGGAGCGATGTATTAATATTTTGCCTGTTCTTTATTTTTTGT
GTTGCAGACATACAATGAAGTGCAGCGGTGTTTTCTGACTGTTGGCTTGGTTTACCCTGAGGATTTGTTTACATTTCTT
CTTAACGTAAGGACATCTTTTGTTTTATGATTATGGCTCTAGTTATTCTTTGTATATGTAACGCAAAACGGTGGCAATA
CCTAGCACTCATATTAGACTCAAGAACTATTCCTTGCCACACATCTGTGTGATATTTATATGGGCTTTTTATCTTACAT
ATTTGAAATCCCTGTCTTCCTTGTATACTTTCACCAGAAATGCAAGTTGAAAGAAGACCCTTTGACGTTTGGTGCTCTT
TGCATCTTGAAACATCTGCTTCCGAGGTGTATTCTTTTATCCTTCATCAGTATAACTTATCATTCAGAGTTAATTTACC
ATCCTAACTTAATGATGTTGCATTGTCTTCGAAGGTTGTTTGAAGCATGGCACTCAAAACGGCCTCTTTTGGTGGATAC
TGCAAGTTCTTTGTTAGATGAGCAAAGTTTAGCTGTTCGAAAAGCCCTTTCAGAGGTACTGAGCTGGCGTAGATTTTCT
TATTTACTACTAAAATATGCATGCTTTAGCATAGTGCTTCTACTTTAATGACAGTTGATC

SEQ ID:101
>STAR A17
GATCACGATAATTTTCCTTAATTATCTAATTCTAAGATAGTCTAACCATGAATATTCTTATAATATCTTAACTGTATAG
GAGATTCTATTTCATCCCTAAATTATATTCGTAATTTTATTCGGATATACTTGCTTTTATTTTCGTCAACAGATATAT
ATATATATATATATATATATTATTTATTTTTAATTTTCATTAAAATTAGTGATTTAATTCTCTATTATTTGTGTACTAT
ATAAAACAAACAAATGAATCTTATAATGTTTGCTTTTTCGTCCATAAATATTTCCGGGAAAAATCGTTAGATATAAATC
GAACCTAGTGGTGAGTGACTCACACACATGTGACAATTCCCAAAATAAGTCCCCCACGTACGCTATGTCTGTTTTAGTG
TGCATGTAGTAACTATTATTTACTGATTTAGAATATAACTAGCATTTGCCCCTATTTAGGGATAACATTGTTTTAGAT
TATATCTGTTACAACTTTTTAACTAAAAATTTTAAAATAAAGCAGACAGTATTAATATACAACAAATTTATTATCATTGA
TCGAAGAATATACAAAGATTAAGAAAAAGATATAAAGAAGGTACAACTTTTCTACCCAATGAATCAATTGCGATAGGCA
ATAACTAACAAATCAAGAGTTTAGAAATATAAGAGAGTATAAGTACGAAAATTATGCTGGGTATATACATGTCCGCTTA
TTTCATCATTAGCTCCAACCAATTGTAATGTGTTCTTCTTCTCATCATCAGTAATTCAGTTTACAAACATTCGTTGACA
CCCAAAGCTTGGAAGTCTAAAAAAAATGTAAAATGTGCACAAATAAGTAACTACATGACGCAGACGCTGCCTTTGAAA
CAATATCAAAGATATTGCAGATATAAAGAAGTAAAATAAGAGATGACTTTAAAATTGAAGTATTTGTATTAATACAAAA
ATCTTGCGTGAAAATACAATTGCAGTTTAATACAAAAAAGAAATTGCAGATATAAAGAAGTAAAATAAGAGATGAAAGA
AGAATAGTAAAAAGTATGAGAATTAATTTACCATCAAAAAAACACTTGAGCTTCGATTAAGATATTAAACTCACCCTTG
TTTTAAGGCAACTGTTCAGATGAGAAGCCAAAATTTGTCGTTGTTCCTTGAGTGTTTGTGAGACGGGAGAATCATAGGC
ATTGATTGTATTAAAGAATAATCCTATGGAAAAATGGAGATGTATGAGAGAAATCGAATTCAGTCAAATAAAGCAGAAA
CAAAGCAAAAAAAAAAAAAAACCATAGAAATCTAGAAGAAGGATATATGATTTTCGGATCTATGGAAAATTTCTATATA
TATAAAACAAAATTACAAACAGAAATAGAAGATGGTAAATTGGTTCATTGAGATGAACAAAGTACCTGATTTCTGAGTA
ATCGATTAATGATCTTGAGAAACCCATTTTTGAGATTTTACACAGTAGTCATGGAGTTTTTGGAAGAGAGAAAGTGGAG
ATGTGGAGATCGTGGGGATGAAAGAGAAATCATTTGAGAAAGAAACAAAGTTAAATAAAAACGACACATACTATGCGT
AAAAATGAAAAATAAAAAATAGTACTAAGCTGATGTGTCAATCACTGAATGCATTAGTTATTGGAAAGTGACTGCTG
ATTTAGTATATTTAGATTAGAGAAAATAAATACTTGTAATCATTTTTCTTATTAGCAATGTTGAAGTGAAAAAAAAAG
AAGAAAAAGTGTATATTTATCATACTCATAGTGGGAAATTGATAATTCAAAATTGCTGATAAACGTTATGAAAGAAGG
TGGAGGATC

SEQ ID:102
>STAR A18
GATCTGTTGATTGGTTAAATCGACGATCTCAACGGCGGAGGAAGTGACGATGAAGGCGCGGCAGAGAGGACAATTAGAG
TGAGATTTCAACCAAGTATCAATACAAGGAACGTGAAACGCGTGGTTGCATTTAGGTAACAATCTCAAGCTCTCGTTCT

FIG. 26 (CONT)

CTTGAAACTCGCTTAAACAAACAGAGCAATCTGAAGATTCAACAAATCCATCCATCTTTCTGTATTTGTAAACAGTTAT
CGATTTAATCAGAGATTCATCGAGTCCATCGCCACCACCACCACCAATCGTTTGATTCGGATTCGTAGCTCCGTTGTTC
TTGTTGTTGTTGGTTCCTTGCCAGGTGTAATCTGATGAGATTCTGTTTATAGCTGCGGCGGAGGTAGAGGAGGAGTTGT
GGCGACGGCGGTGGCAGTATTTGGAGATGAGAGTGTAGTAGCTGACGAGGATGAAGGCGCTAGCGAGGATTCCGATGAG
AGCGATGAGGAGAGGAGAGAAATCAGAGGAGGAAGAGTCGTCTTCGTCGTCGAGATAGAAGGAAGGAGGAGGAGGGAAG
ATGACGTAACACCATTGAGGGCAATAGACACTGCATACTCCTTGAGAACAGTCTCTGTATGAATCGTATGTTGTACCCC
ATGGATTAGGGTTTCCTGTTGAACCCATTATTTGATTGTTGGAGAAAGATAGAGAGAGAGAGCAAGGAAGAAGATGGAG
GTGTCAAGTGTCTCTCTCCTTTTTCTTTGGGCTCTGCTTTTGTCTGGTAAGTGTCTATTTTTTATTTCGAGTTAATTG
GTATTATTAGAGGAGATAATGAATAAATATATATGTTCATGAAAGCTTTTGCATGATGGTGTTAATACTAATTGAATGA
TGTTTATAGTGAATGTTCTACTTTATCAAATTTTTATTTCTAGTATGAATAAAGGTGTAGAATTTGCTTTATTCATTTT
TATTCTTTAGCTTTCTCTTTATGCTTCCATTTTTTTAAAGATAAATTAATACATTAGTAAAATAAATGGAGTTCATTT
TTTTTTTTTTTGATTTTATTTTGAGAAATGAGAACGTAACATAAGAAGTGTTTTAGTGTTGACGAAATAAAAAGAGAGA
GAGGGTTTAGTCTATTTCAAGGCATAAAAAAATGGTTGGTGAAGTGTTGACGAAGGTGGAATACTATAACATGGGCCAC
GTGGATGACAAATTTACTCCTCGACGTATCTATTAAAGTTGTGGTCAGAAATACAGTACAATTTACCGACTACCTACAT
GGAAGAAGAATATTTTCATTTCATTTCAACTACAGTAGTATAACATTCACGTTATACGATTTTTCATTTTTGTTTTGTA
ATCAAAGTAATGATTTTCCAAAAAAATCATTGCTATGATTCGAATACATACAGTTTTATATTAGTTTACATATTTATGA
CAACTATAATACAAAATTTTAATAGTTGTTCAAGGGACGATTGATGTGAACTCGCCAACCATATGCCCTACGTACAAAA
TAACATATTTACATGTAGAAGTTGAAAATAATAATAATAAAGTGTGATTAAAAACAATTATACAAATGCTAACAATAGG
CTACGAGATC

SEQ ID:103
>STAR A19
GATCTTGATGTGTGTTTTGTGTTTTTGTTATTGCAGGATGTATGTTTCATAGTGAGACAGGGCTTAAGAGCTTTGACCA
TCCGACTAATATGATGAAGGCAATGCCGAGGATTGATAGTGAAGGTGTTCTTTGTGGAGCTAGTTTCAAAGTTGATGCT
TGTTCTAAGATCAATAGTATCCCTAGAAGAGGAAGTGAAGCTAACTGGGCGCTGGCTAATTCTCGTTGATTTTGCTTCT
AGTTTCGTTAACTCTTGCTTCTTTGTTGCGTTTTCTTTTTATGTACTCTTGTTTATGTAAATATAGCCTTATGAAGACG
ATAAAGAAATAAAATTGATTTGCTTCTTCGTGACATAGCAGTCTTTACTTAGACAACTGTGTGATAAATTCGCAATCTC
ACTCTTTGATAGATAAGAGGGAGGGAAGAAAGCAGTGGTAAAGACAAAACTGTGTTGATTTTGTGAATTTAGAAGTTTA
CAATAGCAAAAAGAAACTTTGGTCGACTTTTATCATTCATCGTTCCACATGTCTGTAAATTCATCAGGCTCCAATGGG
TTTGAGAGTTCATGCATCTTTCTTCTTGTTTTTGCCTTTATTTTCTTAGCAAATTTCCCAGCTTTATTTCTTTTCTCCA
AAGCTCGAATCTAAAAGGCAGGAAATTGGAATATATGAGAACTCTGACAGATAATCATATATAGCAATGTGATC

SEQ ID:104
>STAR A20
ATCGTTTCAAAGCATGGTCTAATGATGATCCTGATCTCCGACTGATCCAATAACGGTTAAGCAACGCTGTTTTTGATCC
TCCATTGTTGTTTGCCATCGATCAACACTCAGAAATAAGGTAATTAACGCATCTCGAGACTCATTGTTTTAACAATCTT
TGTTTTGTTTCTTCCAAATTATTCTCGTGAATATCCGTAATCTCTCCGTCTTTTAATGAACAACACATATCATATGCTT
TTGTTTGTTTGTTTTGTTTTTTCAACATTTCAATAATTTTGTCTTTTTTCTTCGATTTAATTTGTTTATTTCCTGCT
ATAATAAACGAAAACTATAATTCCATGTAATGTTCGTTGTTGTTCATAGTGATTATCATAACGAGCAACAACATAAAA
ATCAAGAGAATAAGAAATTAGAGTTATGCTGCTTATTTGAATTAGACAAAACCTACTTTTACTTGTTAAGGAAATGAAA
AGATGTTAATAAAGATGAGCACATCGTACGTGGCGCACGTGGAAGCACTTCTGTACGACGGACCCAGTCCAACTCGAAC
CCCACACACATAGCAAAGGTTGTTAAGTTGGCTCGTAGGTGAATTTAATACCTGTTATTTCCTTTATAGCTGGCTAATT
ACCTAAATTCGATCCATAATAACACATTCCTACTATGCCAACATTTAACCCTAGTCAAACTAATTAAAACGTTTCTTAC
TTTTTGGCCTATTAAAACGTTTCATTATGTTCCGCAAATAGTATGAAATATATAAAGATTTTCTAACAAAAAATTACTA
AGAACAGTTAGACTGATTGAGATTGTTTTTATTTCCTTTTATTTAATTTTCTTTTATTATACTCTGTTTATTTGTGTTT
AATAATTAGGATTCTATTTGTCTTGTCTTGTTTGCTATAGTTGGAGTTTTGTTCATAAAGAATGGCGTTTAATACGGCT
ATGGCGTCTACATCTCCAGCGGCGGCAAATGACGTTTTAAGAGAACATATTGGCCTCCGTAGATCGTTGTCCGGTCAAG
ATCTCGTCTTAAAAGGCGGTGGTATACGGAGATCGAGTTCCGACAATCACTTGTGTTGTCGCTCCGGTAATAATAATAA
TCGCATTCTTGCTGTGTCTGTTCGTCCGGGGATGAAAACGAGTCGATCTGTGGGAGTGTTCTCGTTTCAGATATCGAGT
TCTATAATCCCAAGTCCGATAAAAACGTTGCTATTTGAAACGGACACGTCTCAAGACGAGCAAGAGAGCGATGAGATTG
AGATTGAGACAGAGCCAAATCTAGATGGAGCCAAGAAGGCAAATTGGGTCGAGAGGCTGCTTGAGATAAGGAGACAGTG
GAAGAGAGAGCAAAAAACAGAGAGTGGAAACAGTGACGTTGCAGAGGAAAGTGTTGACGTTACGTCGTGGTTGTGAAGAA
GAAGAAGGTTGCATTGCGAATTACGGATCTGTAAATGGTGATTGGGGACGAGAATCGTTCTCTAGATTGCTTGTGAAGG
TTTCTTGGTCTGAGGCTAAAAAGCTTTCTCAGTTAGCTTATTTGTGTAACTTGGCTTACACGATACCTGAGATCAAGGG
TGAGGATTTGAGAAGAAACTATGGGTTAAAGTTTGTGACATCTTCATTGGAAAAGAAAGCTAAAGCAGCGATACTTAGA
GAGAAACTAGAGCAAGATCCAACACATGTCCCTGTTATTACATCCCCGGATTTAGAATCCGAGAAGCAGTCTCAACGAT
CAGCTTCATCTTCTGCTTCTGCTTACAAGATTGCTGCTTCAGCTGCGTCTTACATTCACTCTTGCAAAGAGTATGATCT
TTCAGAACCAATTTATAAATCAGCTGCTGCTGCTCAGGCTGCAGCGTCTACCATGACCGCGGTGGTTGCTGCGGGTGAG
GAGGAGAAGCTAGAAGCGGCAAGGCACTTACAGTCGCTACAATCATCTCCTTGTGAGTGGTTTGTTTGTGATGATCCAA
ACACATACACTAGGTGCTTTGTGATTCAGGTAATATGTGTTCAAAGTTACTACTTTCAAGCAAATCCTCTGTTTCCTCA
CATCATGATC

SEQ ID:105

FIG. 26 (CONT)

>STAR A21
GATCTTCTTCTATATATACCGGTATAAGTCAACTGGCGGCTGAACAAAGGTCGTGAGGTAACAAAATATGAGACAAATC
TACAGGTCAGATTGGGTTCTGAATTCTGATAAGGTCTTAAAAAGGAGCTCACCAACCCACAAAACCATGGATTGAACAA
GTACAGGTCATTGCCTTCATTTTATTCTTTACTTTTCTAAGGCTCAAGCTTCCTTTATTGCCTTTAATAACAATATACT
AATGAGTATTTTGCACTCAGTAACAAAATTCAGGAGAGTAATTTTTTGCCCTAACATGTTACTTTTATGTGTTAAGAGT
TTAGAATTTTGGATCTATGATTTTAGTTTTTGTTAGGGAATCATATTCATATAAATAAAATATTGCCATTGACTTAATT
GTTGTTATTCACCTAATTTCTCTCCAAATTTGGTCATTTACCTCAGTTGATTCTATATTATACTTGCTAAGTGTTCTTT
GTCTAATTCTCTATCATTGTTTGATTTAATAATAACCAAACCTTAAGACTTGGAAGCAAAGAAGAGAGAAAATCCCAAT
TAATTTTTAATAATTCAAAGAGAGATATTGAGTGACTTCCACTAATACAAAGAAAGCTTGGTTTGTGCAATATTTTGCG
GTTAAGCTATTAATTGCTGAGGCAACACCTTTTCACACTTTGCTTTCCTTCTTCCAAGTTTTCAACTTTTCTTTCTTAC
TCTTTCTATTAATCAAACTGCAACACAAAAATCATTTGGATAATACATGTTTAGAAGATGATTAAGCTTTAGTTTTATT
TCAAGATTATCATAATTGTTATCTGTTGTTACCTACATTCATATAATCTTATCAAAAACGATAAAGACAAAAAGGGGAT
ACAATATAGGTTTTTATTATAAAGAAACAGGAAAGAAAGAAAAGGGTTTTCACCAAACGAAATTAGTTCAATCATTTAA
ATTATCTTTATCCTTATGATTAGTGTCTTTATATCTGTCATATGCTGCTTCTCCTTCCAACTTCCTTTGGATTATATTC
TCTTCTCTTTATTTTAATTTCCATTTGTGGTAGCTGTTTTATTTTTTGTATTTTCACGCCGTGTCCCTTTAAAATAATA
TTAACTACACCACTAATGTTGGAACATGAAAACATGAATGAGGTAATTATGATGATGAACCAAATGTTAAGGACAAGC
TCGGTGTAACTAAGAAGATAATTAGTGAAACAGAACAAGTCAATAACTTGTAAGCATTTCAGAATTGAAAATAAAGATA
AGGGAGGATGAATATGAATTTAGTAAATGGGTAATGAAAGTGAAAGAAGAAGAGGGAAGGGTTGGTTACTGTCTCAAGG
GTTTGAAATGGAGACGGTTGCTTGAGAATGAGGAAAAAGAGTTAGTAAGTTTTTAACTCTCTCTTTCTCTCTCCCTCTC
TCTTTTTCAACGTCAATTCCTTTAAGGAATGGCCTCTCTCTCTCTGAAAGTGTGTGTGTATATATTAAACGACTCCA
TTTCTCCTCTGCTTAGACCAAAACTCATCTTCTATACTGCAACAAAGAAGGAGGAGCCGTTGAGACTACAAAATGACTG
CAGCAGAAAACCCTTTTGTATCTGACACCTCTTCTCTGCAAAGCCAGCTTAAAGGTTCTTATTTTTCTTTCTGTTTATT
GTTCATCAACCCTTATGAGTAATTTGCTTGATGTTGAGGTTGTTCTGCTTTCTTTTAATTCCACTCTGCAGAAAAAGAG
AAAGAGCTTTTGGCTGCTAAAGCTGAAGTTGAGGCTTTGAGAACAAATGAAGAGCTCAAAGACAGAGTCTTTAAGGAGG
TAACATGCATGATGATC

SEQ ID:106
>STAR A22
GATCCATTAAGAAGCAGCCGCAAAATCGGATTGAGAACAGGAAAAGAGGCGGTTAAGGCTTATGATGAAGTCGTTGATG
GGATGGTTGAAAACCATTGTGCCCTTAGCTATTGTTCAACTAAGGAGCACTCGGAGACTCGTGGTTGCGTGGGAGTGA
AGAAACTTGGTTCGATTTAAGAAACAGACGAAGGAGTAATGAAGATTCTATGTGTCAAGAAGTTGAAATGCAGAAGACG
GTTACTGGAGAAGAGACAGTATGTGATGTGTTTGGTTTGTTTGAGTTTGAGGATTTGGGAAGTGATTATTTGGAGACGT
TATTATCTTCTTTTTGACAGAAATACATTGAAAACTACCGTTGCTAATTTGATAGGTATACATATATAGACATGTATAT
ATTGTATAATTATATGTCAAGATTATTTATTTATTTTACATTTTTCACAAAAAAAAAACGTTAATCTATTTTCTGTCAC
AAGTGTGTTTTATTCATACTACATACTACAACGCCAATTTAACATGCCAAATATAAAACATACATGGGCAAAGGCCCA
ACAGCCAGTTTAAAGAACTTTGTCTGAAGAGAAAGTTGTTGTATATATCACAAGGGATATGTGGTAATTGGGAAACATG
TTGGGTTGACACGTGGGAAATTGAAGGAGATGGAGTTTCCGTCACTGGTAGAATCTTCTAACACTAGAGAGCTTCAATT
CAGGTTGAAATCGTCAGAAAACTAATGCAGACGGTAGATC

SEQ ID:107
>STAR A23
GATCAAAACTTAGTCAAATCGTTCCTTCCATTTTCTTTCAGTTTGATTCCACTTTAATGGCGTCATAATCATCTCTTAA
ATCAAACAATGACTCCACTATCTCGTTTCCGATCTCTTGTTACATAAAGTTTTCTGTAGCATTGAGATTGTCCTTTTCG
GAATTGCTTTTATTTGCGCAGCTTGATGGAAACAACAAACAGTGTAGTAGTTTAGTAGAAAGACTGAGAGATAAAACGA
AGAGTCAAGTTCCTAAGTCCATTACTTGCATTAACCGCTTAGAGATATCGCGTATAGCACCATTACACGCAACGATGAA
TAGCCCGAAAGGATTTGGACCTCCTCCTAAGAAAACCAAGAAGTCGAAAAAGCCAAAACCCGGAAACCAAAGTGATGAA
GACGACGACGATGAAGACGAAGATGATGATGATGAAGAAGATGAACGTGAGAGAGGTGTAATTCCAGAGATAGTGACCA
ACAGAATGATAAGCAGAATGGGATTTACAGTGGGGTTACCACTCTTCATTGGTCTTTTGTTCTTCCCATTCTTTTACTA
TCTCAAAGTGGGATTGAAAGTTGATGTGCCTACATGGGTTCCGTTTATTGTTTCGTTCGTCTTCTTTGGTACGGCTTTA
GCTGGTGTGAGCTATGGGATC

SEQ ID:108
>STAR A24
GATCAGACTGAACTCGTGTACTCTGAGCCTTGCTTCTTGTAGCTCTTTTAGCTTTCACATTTTCATCAGTATTCACATC
ATTCCTGATAATTGTGCCAGAAGTCCCACGACTATCTTGTTGCTCACTAATGGTTGCTGCTGCAGATGATTCCATGTTG
TCCTCTTGTGAAACCCCAATGCTTCGTCTAGCAACTGTATTTCTTGCACTTCCTGCTTTGCGGTTTTTACATTTGGATG
ATGCAACTTTAACTTTAGGTAGCTTCTTTTGAGTAAGATCAATCTCATCTCTACCTAGGACCTGCAAATCGATGAAATT
TGAGTTCATTTCAACACACTTGATGACACTATCATAGAAAACAAAAAGACCTTGCTGTACCAGAGTGAAGAACAGCCTT
TACCTTGGCCTTCACAGGACTAGGTAGAATCTCCGGAGAACAAGGCCTCTGAGTCCATTCAAACATTTCGCTATCAAAC
ATGTCACCTGGATTGGGCTTTTGTTGCTCGTCTTCCTGAAACATTCATCGGAAAAAAAGTAAGATCAAAGGATC

SEQ ID:109
>STAR A25

FIG. 26 (CONT)

```
GATCCAAACTCTGCAATGTATATTACGAAGTCGTTTGATATAACACCTCTCTTGATAAAAGATGATTAGAACCTAAAGT
AATTTTAAAATATGGTGAAAAATTAGACTCTTGGAGTATATAAATGGCTCAATCTGTATTGCCCGCACCGCCCAAACTC
CCATGGCAAATCCATTGACGAAACCAAGGTAAAAATCACATGCTTTGAGCGTTTTTTTAAAACAGAAGTGTAAGCTTAA
ATTTTTTAGTTTAATAGTAGTAACAAATTCAACCTTGTGAAGAGATTTATTAATAATATTAAAATCATTCCCCTAATTA
TTTGCCTTGAGTTTCGAGCCTTCTACTGTACCACTCACACATTAAAAATCATCAGACTATTCAAACTTTCTTACATGGT
TGATTAGTTCATCTCATATATGCTCAGTATCATACTCTTGCAGATTAATTTTTCATTTTAATTATCAACGAATTTTTTA
TTTAATTATTCATGACCAAAATACATTTATTTTTTTTAAATAAAACAAATAATAAATTTGGAAGTCAAAAATACAATCA
ATAGAAAAAAAAGTATGACAGTGATAGATAATATTTGCAGAATATTATGTGAAAGCTATTTTCTCTGTAACAATAAATG
AGAAAATCTTTATTATTTTACATGAAAGAAAAAGAAAACAAAACAGAGATATTTTTCCAGCTGAAAAGAACAAACATCT
CTCATTGATGTTCAGTGAACTTGCACCAAACTTCACTTCTTCTATACTTCTTCATAGCCACAAACTCAGTTCTTTGCAA
GAAACACAAACTTAAGTATTCAAAATATCGTCATCATGTTCTCAAGATTCCATGCTCTGTTTCTTCTCCTTGTTCTTTC
AGTAAGAACATATAAATGTGTATCTTCATCTTCTTCTTCTTCTTCTTTCTCATTCTCTTCATTTTCTTCTTCGTCT
TCTTCTCAAACTCTTGTCTTGCCTCTAAAGACCCGAATAACCCCAACGGATC

SEQ ID:110
>STAR A26
GATCCTCGATTCTTATCTGGATACAGAAGAAAACACCTTTTTGTCTTTTAAGTACTCGGAGAAATCTGAGGGTATCTTT
TTCTTGAGCAGATGGAGGTGAAGTCCTGAGTTGGGGAGGAGGGGGCTCTGGAAGACTTGGCCACGGTCACCAGTCCAGT
CTTTTTGGCATCTTAAGAAGTAACAGGGTTTGTTTTACTTAATTTCAATATCGTTTTGTCTCTTTCTCATGCATTTTTG
CTCACAAGAATTTTCCCATTTCCTCCTTTACTTTATCATGATTCCTTCATAATTTTCTTGTATTGCACTGTAAAGTATC
CCCCTGATTGCAGTGAGTTTACTCCAAGGCTTATCAAGGAACTTGAGGGGATCAAGGTAATCTAGTGGTGAAGAATATC
CACCTTGGATGAAGAGTTTCTAGTTACCTAGTGGTGGTTTTAATCTTTAGACTTTCATGCTTATGTTTTCCATTCTTT
CTGTCGAGCACTAGGTCACAAATGTTGCTGCTGGTCTGCTGCATTCAGCATGCACTGATGGTATTGATTTACTTTCTTA
AAAGTATGAATGTTGTGCCATTTACCGAACTTTATGAGGTTTGTTTGCAAATGCAGAGAATGGCTCTGCTTTCATGTTC
GGAGAGAAATCTATAAACAAGATGGTAAGAAAATGTCTTTTTCTTTGATTTCTGTGGTCATATATGTGAAGCTATCTGA
TGGCAAAATACAGGGCTTTGGAGGAGTAAGAAATGCCACAACACCATCGATTATCAGTGAAGTACCATATGCAGAAGAA
GTTGCATGTGGTGGCTACCACACATGTGTAGTTACAAGTAATACTCTCTTATTATATCGTTCTTTCTTTGATATTGAGT
TTGCTTGTATACTGCAAATGCCTGTCCTGCTCAAATTTCTTTTTGTTATTCTTTATAGAGGCCCAAAACTGCTCTTTAG
TTTCTGCTAAATTTATGAACATATTGTGTTTGTAAGATGGTCGATAACAACTCATCGTTTGATGTTTCCTTCGTTTTTG
GAAGGAGGTGGGGAGCTTTACACCTGGGGCTCAAACGAAATGGGTGCCTTGGAACAGAGTAAGTTACATACCCCGAAA
AAATAGAATGTTTCCCCATAAGATGAAAACAAGGTTCTTGAACTGTACCTATACTCTTATTTCAAAAAATTCAGTTCAA
CGTATGTCTCACACTCCCCTGTGAGAGTTGAAGGTCCTTTCTTGGAGTCTACTGTATCTCAGGTATCTTGTGGGTGGAA
GCACACTGCAGCTATTTCAGGTAGCATCTCTTTTGAGTAAAACATATTTGTTTCCTCTCTCATTGTATAAGTTAATTCA
ACTCAATTTCTGAAACTTGTTTGCAGATAACAATGTCTTCACCTGGGGCTGCGGAGGATCTCACGGCACATTCTCTGTT
GATGGACATTCCTCTGGTGGACAATTGGTTTGTTTCATCATCTTATCTTATTGATCAAATCTCTGAAACAACATTTTCA
AGTGTCGAAGAGAATAAATATGGTATGCTTAATATGTAGGCGCCATGGTAGTGATGTAGACTATGCAAGACCAGCAATGG
TGGACTTGGGAAAGAATGTAAGAGCAGTGCATATATCTTGTGGCTTCAATCATACAGCAGCAGTTCTTGAACATTTTTG
AAGACTCGGTCTCAAGTTAATATCATATACAGATGTTTAGTTTATTCTTGCTTAAACATCTATAGACTAAAAAATAAT
AAGAAATTTACACTATTGAATAGCGATCAATTACACCATTGGTTCTAACTTGAACAATTTAGTAAATAGGTGGAATATT
CTTGTCGTGTAAATTATTGATTTTATTTATTTATTTTTGAAAACTACAACAAACGATAGAAGAGTTGAGGAAATCTCTT
TGTAATCATAATTATGAGAAAATTAAGATC

SEQ ID:111
>STAR A27
GATCGGAATCATTTTGGGAGTTTGAAGGAACTAAACATAATATGCATGTCGAAGTCAACTTATTGCAAATAATTTTGAA
ATGATTCTGAATTGGAAATTCATGAAGCTTAATTATTTTATCTAAATAAGTTTAATATAGGTTTGAGTGAGATATCGAG
ATTAAATGATAAGAGTCTTTCTTCGAGGAGACATTAGAATTCTACACAAAAATCGAAATTAATCTAGTCCTTGACAATC
AGTTTTCAATTAATCAAAAACCTATAAAATTCAACTCAAAACCAATCGTATGAAACTTCATTATACCATATAATCTGGT
TACTTAGCTTAAATCTCTACCCGGCGATGTTTCATGCTTGAGAGACTAGGTACATAGGACACTAGGAGTACTGCATATA
TGGTTACCTCATGAGTTCTCATCGTAAAATCATCCAATAAAAAATGGTTTCCTGCTTAGGTATACGGTATACCATCTTG
TATCGTTAAAATTTATAGCTCAGTTCGTTGCTAACAGTCAAATACGTCTTTCCAGGGTAAAAAATGTGGAAATTTGTTC
CACTGTAAAAACCTAATAATTTTTGACATTAATAATTAAAAGGGATTATAATGTAATATATACAAAGATAGGGGAGACA
CAGACGAAGGCCCACACATCTTTAACAAAAGAACAACAAGCCCGTGACCCCAAAATAAAACTAGCTTTCAGATTTATTA
TTTTTCATCTGACATAATTGCAACCGTTAGATTTCATTTCTCAGGTCCCATTCTGACTCAGATCCAACCGTCCATATTC
CTCTAGTGTCTTCAATAGTTGGGCCCCTTTTCTTTTTCCTCTCGCCGTACACTCTCCTTCCAGCGCCAACGCCACCGCC
CGAGCCACTTCTTCCGCCGGCCGCCACCGCGATTTCCTCGCCGGAATCCCCTCCTTCGCCGCCTTTCCCGTAGACCACG
AAAGGATGCTTATGGCGTATTCTCTCCCTCTACCAGCCAATCTCGCCATCACCGCTACCATCGCCGGCACCGTCATCGC
GTGAGCGCGAACCTCCGCCGCTCCTTCTGCCGTTGTACACATTAGCTCAAGAGCAGCTAAGGCTCGCTCCACCGCTGAG
ATC

SEQ ID:112
>STAR A28
```

FIG. 26 (CONT)

```
GATCGAACTTTGGTAACATGCTTGCTTACTGCTTTCTATTGTCTGCAAAACCTCTGTTCTGCGTGACCTTCTGGCCCCT
CTCTCTCGAAGCTTCAGAACTATGGAGGAGAGATTGGATAAAGGAGACAAAAGGTGTGGTGTGGCGAAATGTTAGGGTA
CCGGCAATTGTGTATGTATGAGTTGATTTTGTTCTTTTCTCATAAAGAGGATTTAACAAAGGATGAGAAAACAAATCCA
ACTTGAGTACTACGAGGAGATAAAAGCTTTTATTGGGTATTGAGTATTGACACGTTGTTGAAAGTCTGATACATTTTAG
ACTTTTACTGCATATGTCCAAATATTTAGATTTTTTTTTCGTTTCTCAAAAAAGTAACTTGTTTAACAAAAAAAAATCG
TTATTGGGCTTTTCGTTTCTTTTATATTGGGCCTTGAGCCTTTTTAGCTTTTGTATTTTTAGTCCTTTTCGGGTTTATT
TATTTATTAATAAGATACCAAAAACATAACAAAAATGTAGTTTTGTATTTTTAACCTAGTCTTTTAAATATTTAAACTT
AATTAGAAAAATTCTATTTAAAATATTATAAAAAAAACATGATTTTGTGATTTTCCCATATTTTGTGTAACTATTTTTG
ACAAGCTTTTGAAACAACAAAGACAAAATCCATGTGATAAGGTCGGTCAAAAATCTTGCGTAGTAGAGGAGTTAAAGAT
TTTTGGATGGTTACAATGGTATACTCTTATTTGATATCCCATCAATGGTATATAGCTTTGAATGGTAGGACAAGTGAGA
GTAAAATTTTCTCATCATTGCTAAGTTTTTATTTTAGGTTCTACATTGTTTCACCCTTCTTAAGTATCCTACTCTCAACT
AGAAAAAAAAATTGTGAGGGCGGTTTTATCGGCTGGAATGCAGCTCATGTAGCTCCCACGACGGAGTTTTCTGGCTAAG
AAACTCGGACACAACGTTGGCCTCCAATATCTTCAAGGCTTCTTCATTCGTCACCGACCTCGGTGTCTTATACTGACTC
ACAGAAGAGCCTCTAGACAGAAAGAAGTTCATGAGCTTGTCGAAAGCGCCAGGCTTAACAACCTTAATCTCAAGTGGTC
CAATGTTCTTATCATTCTTTCGTCCTTTTCTGTAAACCGCGTCCAGAGACTCCTCAATGGTGAAGCAGCATTCCTCCAA
AACATTCTGGTCAAGCTCAAGCTTGGCGTCCTTGACTTTTCTCCCGAGTTCCCAGTAGAGCACGTAGTGACCTGGATAC
GAGGAGGAATCCACACGGCTAGTGAAATCCATGAGCATTAGGTCATGTGGCTCAAGCAGGAGACTCGCGTTAGTCACTG
CCTTGAGGAGGTCTTCGTCGTAGGTCTTGTCCATGTCGATGCTCAGAACAACTTTCTGTCTTCCCACGAAATGAAACTG
TGGCGCATTGTTGTAGAAACCAGTCACTCTTAAAACGTCCCCTAAACGGTACCTATACAAACCTGTATAAAGAATTTTG
ATACACATTAAGAAAATTATTAACATGTCATTTAGTTTTGAAATTGAGAGAGTAAACAAGAAAAAACACTTACCAGCAA
ACGTTGTGACAACAGGTTCATAATCATGACCGATTTTAACATCGACAAGATCGACTACAACAGGATTCTCTGCGGGATC

SEQ ID:113
>STAR A29
GATCAGAGTCACAACCATAGGAGTCGGAGACGGCCATGCATGTGTCTTGATAGAAGAATTAACCGGTTCTAAATCTGAA
AACGAATCCGGTCGTCTCGAACCGAAATCAATAACCGGTCCGGTCAAAGAAACGGTTGCACGAGTGAAGGAAACGGTTA
CGAAAACGGAGCCGTTAATATGCGATGACGGAGTGACAAAGGGGAAGCTGACGATGTGCTACGAGGTAGACGTTGACGT
TGACGGTGGGAGGTGTGTTAACGGAGATTTAACGGCAGTTAGCTACGGAGGAGGTTTGGGTAATTGTGGCGGGGATTGG
TGGGAGAAATGGGATGGAGTGGTGAGGATGAGAAATGGTGATGACAGTTGGTACCGTTACGTGGATTTAACGGTGATTA
ATGGAAATGTGGTAAGGTTATGGGATGACAACAAAACACTAGTAACGGCGGCATGTGTCTAAATTAGAGAAGTTTCATA
TTTCGGAAAGTTTTTAAATCTTGAGAAGCTTTCTTGGTTTGAAGTGTTTTTTTTTGTTGGTTGATTAAGTTGTAATTT
GTAAATAATTTTCACACAAGAGACCAAGAAGGAACGCTTAAATCAATATCAATTGGTGTTGATTCCCAGCTTTTTCTAG
TCGAACTTAGGTAACACGTCCATTGCGATGATGAATTCGTGACAAGGGGTCAACTATTTGAACACAACAAACAAGTGCG
TTTTCTTGTTAAGGCCCATCTAAAATTGACTACACACATTTACTTTTAGGCCCATTTTAAACTTGACTGTAGCCTGTAG
GCATGTATTTGTTCGTGTTACTCCCAGCCTCAAACCCGCAAAATCCACGAATTCTTCTTACTTAGTCTAGACTCTGGTC
TGATC

SEQ ID:114
>STAR A30
GATCTGGCTAATCCGTTTAGCACACAACCAGATGTAACATTGGTTGCAAAGATTATTGAAGAGTCTCGATCTAATGTAA
CACACCTCTGCGCATTCAGGAGTGCTTACGTCAACACATTCCGGGAACGAAAAACTGTTAGCGTATGTGTATTTTAAAG
TATTACCATATTTCTTTATATCTTCTAGCACCTCCTCACAAATGTCACGTGCGTCCTCCGATTCCAAAGCATAATGGTT
GCTTCCGAAGAGCCGAAGGTAGACACCACCCATGTGAGCATTACCAGCACATATGTAAAGAATTGCGCATGCAAGGGTT
GCAGCGGCGTTCCTTGGGGCGATTCGCTCTAAGTGTAGGATAGCTCCCTGGATGTCAGACTCATGTGTAACGAGACGCA
GTCCTTCATGGTAAATAGCCGTGGGGTTACCAGCTTGTAAGCACCGTTTGAAGAAGGGTCTATAGCGACCTTCGGAGTT
GATGTCATTTGGATCGTGGCCTGCCGCGTAGAAGTCATCGGGATCGTCGCACATGCTGAAAATGTTTGCATTTTTGAGG
ACATCCGGACAGTAGACAATGTCTCTTCCACGAGGACCGGATTTCAACATAGGTCCGAGGTACCACCAACATTTGTCAG
CCATTTTCTTGGCTATCTTCGCAAGCAAATCGTCAGGAATATTTGGGTTTGTCATATTTAGGAGTAAGGTGTTTCGAGA
AAATGAAATTTGAACACTTAAATAAGCATCATTGAAGATATGGTTGGGTAAGTTATGGTTGTATTTATTGCAAAGGTAT
TAAGTGATGATGTGTATTCATATTGTCAAATCAAAGTAATAGTATTCCATATATAATTTGTTATCGTTGTTATGAGCAA
CCTCTTTTTATTAACAGCTTAAAACTAGACGTGTACGTTTTACTGACGGTCTTAGTGTACGTCCACATTTACATTTCTA
CATTTACTCAACAAACAGTGTACGTTGTAGTGTATGTTTAGTGAACGTCCACATTTACATTTCTACATTTGCCCAACA
AACAGTGTACGTTGTAGTGTACGTCCACATTTACATTTCTACATTTGCCCAACAAACAGTGTACGTTGTAGTGTACGTT
TAAGTGTACGTCCACATTTACATTTCTACATTTGCCCAACAAACAGTGTACGTTGTAGTGTACGTTTAGTGTACGTCC
ATATTTACATTTCTACATTTACTCAACAGACAGTGTACGCTGTAGTGTACTATTAGTGTACGTCCATTCATAAATATCA
CCATTTATGAGACAAACCAAAGACCTCATACGTTTGCATGTGTTATTTTTAGTGTACGTTAGAGTTGATATCTCATGC
TAGTGAACGTCCATATCTAGTTTTCCGAGACAAAGAAAAAACCTCTAAGTATTATTTGGTAGATGCACGTGTACGGAGT
TGTGGACGCTTAGATTTTAATATCCAAATTTACATTTACTGCAGTGTCTAAATATCATATGTGAATTTGGCTGAAAAAT
ATTCAACTTGAGAAACATAACACACCTTGCAAATTTCTTAAGCAATAATATAATTTCAACATAAACATAAACAACATAG
TAGAAGGCTTATCATAATTTGAAACATGACATAGCGGATAACATAACAAACATAAAGTAGAATGGAATAACTATAG
CATTTGACTAACACGCCTGGCACACGACCAGAGGTAACAGCGGTTGCAAACGTTTTGGAAAGCTCCTGATACCATGTAA
CAATATAAGGCGCAAGGAGGCATACTAATTCCATGGCTGGTAGGATAAGAGAACGTAGGACCCATATGTATTGCTGTATG
GAGGGTCAAACTTCTTTATTTCCTCGATGAACTCATCACCCAAAACTCGAGTGGCAACCGAGTCCAATGGATAATGGTT
```

FIG. 26 (CONT)

```
GCGGGTGAAGAGCTGTAGAAACAAGCCGCCCATATAATCATACCCAGCACATATGAATACAATGGCGCATGCAAGTGTT
GCATTTGCTCGTACTGGAGCATGACGCTGTAAGAGCCTGATGGCTCCATTGATGTTTCGTTCATGCGTTAGAACACGAA
TACCTTCGTAATACACGGCCGTGGGATTATTAGCTGCAAAACACCTTAAGAAAAATGTTCGATGTCGGCCTTCATCAGC
GGATC
```

SEQ ID:115
>STAR A31
```
GATCAAAAGAATCGTACTTGAAATATTTAGTGGAACGCATATGTCAGAGTTACAGATATGGTTTAACTCTTTTTATCTC
CTTTTTTTTAATGGTGTTTCTCTTTTTATCTCCTATAATCTTTTGGGAATTTTTTATTATTAAATATTAATTAAAAAGAT
AAATTCTTAGAGAAAATCCCAACTGACTTGTTAACTAGTGAGACATATCTTATTTATTCTCTGCTTATCTAAAAAGAAA
ATGAAAAAGAAAAAAAAAGTATATATTAGAAGATTAATATAAGTTTAGGGGGAAAATGATTATTATTACTATTTATAAA
ATTAGTATATTTCAAAATTGTACAATTAATTACTAAGCCTTAAAATAAAAATGTAAAAGAAGATTATCATCAAGAATAG
TATACCATCTTTGTTTCAAAAGAAAAGTTTACTAAAAGAAAAAACTTTTGTTTAATTTCTACTAAAGCTGAAAGGAAAA
TGATTGTCAATTTGTTATTATTATTATTTATATGATAGATTTCTTAAGAAACGTATAGAGTTAGTTACAAATTCTAAAT
TAAAAATTGTATGATAAGATTATCTTAAGAAAGTTATACAATATATTCCTAATTCTAAAAGAAAATGGTTATTTTTTG
GAATAGATATACACAACAAAACAAATTTAGTATAAGAAGATATGTTAGATTAACTAAATAAACATCTCAGGCATGAAAC
TGGATTAGGTTAACCAGAGGTCCAGAGACCTATATATCTCTAGGCATTAGGGTTTAACTACGGAGCAAAGCCTCATAAT
CAAGTTTATATCTTGCGCATCTTTAGCAACCAATCAATTATCTAAGAAGCCATGACTAATACTAATGTTGCTGCTACAA
AGCCTCTTTCTACTATGGTCGATGAATCTCCTAGCCTTCTCCGTGATTGGTGGTGAGACTCTAGATCAATGATTTTTCT
TACTTTTTTCCCATTACTATGGTTACGTAACATAAGATGGATTAAACTGAATCTGATCCTCTTAAATTATATTGG
TTGCAGTATGAACAAGAACCTACAATACAACTTTGCGATGAACTTCGTCATGATAATCATCAACATTGAAGCAATCTTG
TCTATCAGAAACCACGAAAATCACGTAAGGAAAGATTATTCAACGATTTTGATAATTTCCGGTATGTTCTTGCCTTTCG
CCTATTAAGTTGCGTTTGTTGGGTTGGCGCAATCAGGGATGTGACATTATGTGAACTCGCCTACATCTTCGGACGCATC
AGTCACAACATAGGCTTTATTTTCTTCCTAGAACTCCTCTATTGTATTTCTCCCTACTTGGCTCTACTCGTTGGTCTAC
ATGTAGGCCAATGGTATCTAACTTCCATGATTGGACTGTCTCTATGGGAAGGAATGCAAGCATTACGAACTGATATTTA
ACCTCGTTTAATAGTAAAATCTAAACTTATTTAGCTGCATATTTTGGTTTAAGGCAATCGAGAATGTCTTAGCATCTAA
AGCTTACTTCGTGGGACGCATCTGTCACACGTTCGGCTTTTGTATTTTCGTCCACCTCCTCTATTCGGTTTCTCCTCAC
TTGGCTCTATACTTCGGTCTCCCTTGTTGCTAGGTTTCGTAGCCGTCATGATTGCACCAAGTTGTCCGTATCAATGGA
AAGGCCTATGCAACAAAGTGCAAGAGTTACGAGACTGGTGGAAGCATCTGAATCGACCACAATCCTCGGTTGTTATTGT
TCAAGGATCTCCATTTCTAAGATGTGAATTTTAGGACTCTTTTATCCCTTTTGCCTTTTAAATTGGAATACCAACGTTT
ATTATGTGGGTTAGTTATGTGTGTATATGATATACAAATCAAACAACATATATAAGGAGAAGAGATATTGAATGTTGAT
TCTTAATTTACAGGAACATGAAGCTCGGGTCTTTCCGGCAATGCCATCAATATCCGAGGCGGTGCAGTTTCTTCGTCAG
ACGAGAAACCAGAGAGTCTAGTATCCTAATTTTGAACAAATAGAGCATAAAGGAACAAGTTATATAGCTTCACATAACC
CGAAACATGTTTTAAGTTTCAATATCAAAGACAAGATC
```

SEQ ID:116
>STAR A32
```
GATCTAGACATATGTGTGAGACGTTTCATTGTAGGTATCTGAATGTAAAGCTCAAAGCTTTAACCTTTGAACCGATAAA
CCTCTAAAGCTCTCTCTTTTCCTTGGATGAGTCTCACAAGTTAAGAACTTCAGTGAAATAATCTGACTTTATTGAACCC
AAACTTGGGTATCACTGTTTATCTTAGCATTACAGAGTTTTGTTTTTGTTATGTACATTGGATTTGAAGTCTACAATGT
TTTTCCAGGTTTATAAACCGGAAGAATATAGCCGGGTTCTAGCTATCTGTGGTCCTGGGAACAATGGTGGTGATGGTTT
GGTGGCGGCGAGCCATTTGCACCACTTTGGATATAAACCGTTTATTTGTTATCCCAAACGTACAGCCAAGCCACTTTAT
ACTGGACTGGTCACTCAGGTTTGTGTAACCAGTGCTTAATTTATGGGGATCTTTGTTAGCTTTCTCCGTTTCTTTACT
GCCTGCTGAATTTGCCTGTTTTTGTAGTTGGATTCACTCTCAGTCCCTTTTGTTTCCGTTGAGGATCTGCCGGATGACT
TGTCAAAGGACTTTGATGTTATTGTAGATGCAATGTTTGGGTTTTCATTCCATGGTAACTATTTTTGTGCATGAATCGT
TAGAATTCTTCAAAGCATGAAACAATTATAAGAAGTAAATTCATCAAACTTTTGAACAGCAAGTTTTGGAATCAAAGTC
TCAGAGATGCACCTTATTCATTTGCATCATGTTTCAGTTGGCCTTTGAAAATCCATTTTTTGCACATGTAGGAGCTCCC
AGGCCTCCTTTTGATGACCTCATCCGGCGATTAGTATCGTTACAGAACTATGAGCAGACTCTTCAAAAACACCCAGTCA
TTGTCTCTGTGGATATTCCCTCTGGTTGGCACGTTGAAGAAGGAGACCATGAAGATGGAGGAATTAAGCCTGATATGTT
GGTAAGTCTTAGCCGAAATGCTTGTGTTTCTCTTTTTCTCTTGTACTCATTTGTTACTATCTGATATAATGAAAACTAC
TTTATAAATTGAACATATTTACTCTTTTTAGGTATCTTTGACTGCCCCAAAATTATGTGCAAAGAGATTCCGTGGCCCT
CATCACTTTTTAGGTGGGAGATTTGTACCACCTTCTGTTGCAGAAAAGTATAAGCTGGAGCTCCCTAGTTACCCAGGGA
CATCTATGTGTGTTAGAATTGGTAAACCTCCCAAAGTTGACATATCTGCTATGAGAGTGAACTATGTCTCTCCAGAATT
GCTTGAGGAGCAGGTTGAAACTGATC
```

SEQ ID:117
>STAR A33
```
GATCCCGTTCATGTATTTTTGCCAGTTCGAGTTGGGGTTGGTTCTGTTTACTTTTTCTAGTCCATGTATTTTGCAGACC
TATTAAAACCATTCTGTTTTTTTTTTGGACCAACAAAACCCATCCGTTTTTAGATACGAAATAAAATTTTATTAAAAC
CATTATTTTTCTTGGACCATCAAAACCCATCCGTTTAAAGATACGAAATGAAATTCGATTGATAAATACAAAATAAAGT
TCACCAAACTTAAATAAAAAGGCATAGATGGGACCAATGAGAAAGAAATTTCTTTTCTCCTCAATTTCCCCAAAAATAT
ATAAACCTTAAGTTTACTTTTTTGTTGCAAGGAAAAACATTAATCTTTTTCAACTTTCTAAAAACAATCATTTCAAACG
TTAAAGGAACCTCCTCCTTTCTTTACGCGTTTGCAATATAACCCAAGAAGACCGCTTGTTTGTACAACTTTCCAAAAAC
```

FIG. 26 (CONT)

CAAACAGTAGTGTAATAAACCTCTGACTTCTTTTTTCTTCTCTATTTTTGTGGGTGATAATCAATTCACTCGGTTTGAA
ATTTCGTCCACTTTTCAAAGATGAGTGAATGAAAAAGCCACGAAACTTTCCATTTCTTCCTCTGTGTATAACTCTCACT
GAGTACGACTTGCCATTTTCTCATCCAAAAAAAATGTTTATCCAAATACATATTTGTGAACTTTGCTTTTAAACCACTC
AAGATTCTTCCCCATGGCTTCTTCGTCTTCTTCTTCTCGGTCTCGCACCTGGAGATACCGCGTCTTCACGAACTTCCAT
GGACCTGACGTCCGTAAAACATTCCTCAGCCATTTACGTAAACAGTTTAGCTACAACGGGATTTCGATGTTTAATGATC

SEQ ID:118
>STAR A34
GATCCATGCTTTTGAGTTTAAGTGATTTATTTAAGATCCTCTAAACTTTTTTTTCTTCACTTAGTGGTGGTTCCAGTCA
ATTTAGCAAGTAAGATGTTGTATGTGTCAATGCTATAACTGTGAATTTTCAGCTATTGTAGTTTGATTTTTGTCTTTGT
TAGCTTCAGGTGTCTTGAATCTGAATCTGTGGCTATATTTGGTGCTCGGTGGTGAGCAGGAAGGGAGGGGGATATTGTC
AGGGTTTTAATGTACGTCAGATGAATAGAGCAACTAATGTTACTGGCAGTAGAAGGAGGGGGTTTATTCTCAGCGTCCG
CGTCTGGGTATAGTAAGGGATTGACCCTTCTTTTCTCTGGTGATAAAGACGTAGATAGGCCCATGAGAGTTGTCCCGTG
GAATCACTACCAGGTGGTTGACCAACAGCCTGAGGCTGACCCTGTTCTTCAGCTGGATTCTATTAAGAACCGAGTTTCC
CGCGGTTGCGCTGCTTCCTTCAGTTGTTTTGGTGGCGCTTCCGCGGGACTTGAGACCCCTTCTCCTCTTAAAGTTGAAC
CTGTGCAGCAGCAGCATCGTGAAATATCATCACCAGAGTCTGTTGTTGTTGTTTCTGAAAAGGGTAAAGACCAAATAAG
TGAAGCTGATAATGGCAGCAGCAAAGAAGCTTTCAAACTCTCGTTGAGGAGTAGCTTGAAGAGGCCCTCTGTTGCGGAA
TCACGCTCTCTAGAAGATATAAAAGAATACGAGACGTTGAGTGTGGATGGTAGCGATCTCACTGGTGACATGGCAAGGC
GGAAAGTTCAGTGGCCTGATGCTTGTGGTAGTGAACTCACTCAAGTTAGAGAATTTGAGCCGAGGTACGTGTGATATGT
TTTCCTCTTATTGAGTTGCTTAAATCCCAATACGAGTTAATTTAAGTAGATC

SEQ ID:119
>STAR A35
GATCCATTTCATATACATATTACCAATTTTGGCTTTTATAGGTTTGTATCCAGAAGGCCTTTTCGTGGCTACGATTAAG
GAAAATACGAAACAAAGTGAATTTTACTACTTTTGTAGCATGGTTTATTCTACTTTATATACCTAAGAAATATGAGC
AACAATTACTTCTGTAATGACTTTTTACTACTTCGTAGTTGGTACAAACTACAAAAGATTGTGTTGTTTTACATGATA
CTTTATAATATCTATATTAATATATTTAGTCGTGTTTAATCAAAAAAGCACCAGTGGTCTAGTGGTAGAATAGTACCCT
GCCACGGTACAGACCCGGGTTCGATTCCCGCTGGTGCATTGAGCTATGATGATATAGGCTTCAGCATTGGTTGGGTCC
ATTGCATTCTTCTGAACTATCAGTTGATGTATGCCACACCTCTGAGCTCTTCTTTTTTTTCCTCGTCAATTAATTTTT
TAAAGTTTTGTCTGCCTAAAAACTTTCTTCTTTTTGATTAATCATATTAAGCATCTCGGCTATAAAAACCACGGTCTAC
TAACTTAACATGCATTGGACTAGTTTTAGTGGAGAGTGTTCGAGTTAAAATGAGAAGCTCACGATTGCATAACGCAACA
TTTGATTCGCTAGGCATCTCCATTTGTAAAAGTAGCCACTCCAATACAAAATGGTCGATGATGGTGAGTGGGTGAGACA
AACCCACCACCACCTCAAGAAGATATATTTCTCTGGTTAAGAATTTGAATGGTTGACAAAGAAACGGTCACTCTATATA
CTTAGAAAATATAGTCATACATAGACACCATCGGTCTAGTTATAATAATAACCACTGGATTAATGCCCAGTGAAAATAA
TTGAGTAGCCAAAACATGAATATAACAATATCCCAATTTACATACAACAACACAAAGGAGGTTTTACACGATTCTATAG
TACAAACTCATAACAACAAAAAATCACACTTTTGTTTAACAGTTGCCTTTATGGCTTTACTACAGTATCTTGTCCAGGG
TTTTCACACATAACAATCACAGTAAATCGTTTCCTTTTCTTTGCATCTTCCATTCCTTTTGTACACGTAACATCTCCGG
CTTCCCGACCATCAGCTAAGAACCAGATGCGATC

DNA SEQUENCES COMPRISING GENE TRANSCRIPTION REGULATORY QUALITIES AND METHODS FOR DETECTING AND USING SUCH DNA SEQUENCES

CROSS-REFERENCE TO RELATED APPLICATION

Under the provisions of 35 U.S.C. § 119(e), priority is claimed from U.S. Provisional Patent Application Ser. No. 60/303,199, filed on Jul. 5, 2001, the contents of which are incorporated by this reference.

TECHNICAL FIELD

The invention relates to the fields of medicine and cellular biology. The invention in particular relates to means and methods for regulation of gene transcription. The invention further relates to means and methods for determining whether a DNA sequence comprises a gene transcription modulating quality and/or a gene transcription repressing quality.

BACKGROUND

With the progression of various genome projects, sequences of the entire genomes of organisms have become available. The flood of data has raised the interests of many investigators. One of the more noticeable discoveries was the observation that the human genome does not code for significantly more genes than the genome of simple organisms such as the fruit fly.

The focus of many investigators is now shifting from the identification of genes to the determination of gene expression and gene function. Examples of such technologies are DNA microarrays, functional genomics applications, and proteomics. One thing these technologies have in common is that they center around the function and expression of coding sequences.

However, while our knowledge of genes is increasing dramatically, the understanding of how the expression of the genes is regulated is limiting the ability to apply this rapidly increasing knowledge. This is, for instance, the case in the generation of transgenic plants and animals and in human gene therapy. In these applications, foreign nucleic acid is typically introduced into cells to obtain expression of coding sequences. Often, integration of the foreign nucleic acid into the cell's genome is required for prolonged function of the introduced sequences. However, integration of sequences into the genome leads to unpredictability of expression because the surrounding DNA influences the transcription of the integrated sequences. This unpredictability is due, in part, to the fact that introduced sequences cannot yet be provided with sufficient genetic information to functionally isolate the integrated sequences from the transcription influencing effects of the surrounding DNA. Also, this is due to the fact that not enough is known about the transcription influencing effects of surrounding DNA.

SUMMARY OF THE INVENTION

The present invention is concerned with DNA sequences that comprise a capacity to influence transcription of genes in cis. Typically, although not necessarily, the investigated sequences do not code by themselves for a functional protein. Various sequence elements with the capacity to affect gene transcription in cis, have been identified. These elements range from promoters, enhancers, and silencers to boundary elements and matrix attachment regions.

The fact that so many different types of regulatory sequences have been discovered gives the impression that it is very easy to design effective expression cassettes. However, quite the contrary is true. The designing of expression cassettes is still often driven by trial and error. It is quite often possible to obtain some kind of expression of a foreign gene in a target cell or its progeny. However, very often it is difficult to predict with any kind of accuracy the level of expression or the persistence of expression that an expression cassette can display in a target cell.

The present invention provides, among other things, means and methods for detecting and isolating new transcription regulatory elements. A method of detecting, and optionally selecting, a DNA sequence with a gene transcription-modulating quality is provided, comprising providing a transcription system with a variety of a fragment-comprising vectors, the vectors comprising i) an element with a gene-transcription repressing quality, and ii) a promoter directing transcription of a reporter gene, the method further comprising performing a selection step in the transcription system in order to identify the DNA sequence with the gene transcription modulating quality.

BRIEF DESCRIPTION OF THE FIGURES

FIG. 13. Schematic diagram of the orientation of STAR elements as they are cloned in the pSelect vector (panel A), as they are cloned into pSDH vectors to preserve their native orientation (panel B), and as they are cloned into pSDH vector in the opposite orientation (panel C).

FIG. 25. U-2 OS/Tet-Off/lexA-HP1 cells were transfected with candidate *Arabidopsis* STAR elements and cultivated at low doxycycline concentrations. Total RNA was isolated and subjected to RT-PCR; the bands corresponding to the zeocin and hygromycin resistance mRNAs were detected by Southern blotting and quantified with a phosphorimager. The ratio of the zeocin to hygromycin signals is shown for transfectants containing zeocin expression units flanked by 12 different *Arabidopsis* STAR elements (SEQ ID Nos:112, 114, 94, 97, 88, 102, 85, 100, 108, 107, 86 and 104), the *Drosophila* scs element, or no flanking element.

FIG. 26 Sequences comprising STAR1–STAR65 (SEQ ID NOs:1–65); Sequences comprising STAR66 (native (SEQ ID NO:66) and opposite (SEQ ID NO:67) and testing set (SEQ ID Nos:68–84), and Sequences comprising *Arabidopsis* STAR A1–A35 (SEQ ID NOs:85–119).

DETAILED DESCRIPTION

Figure 1:
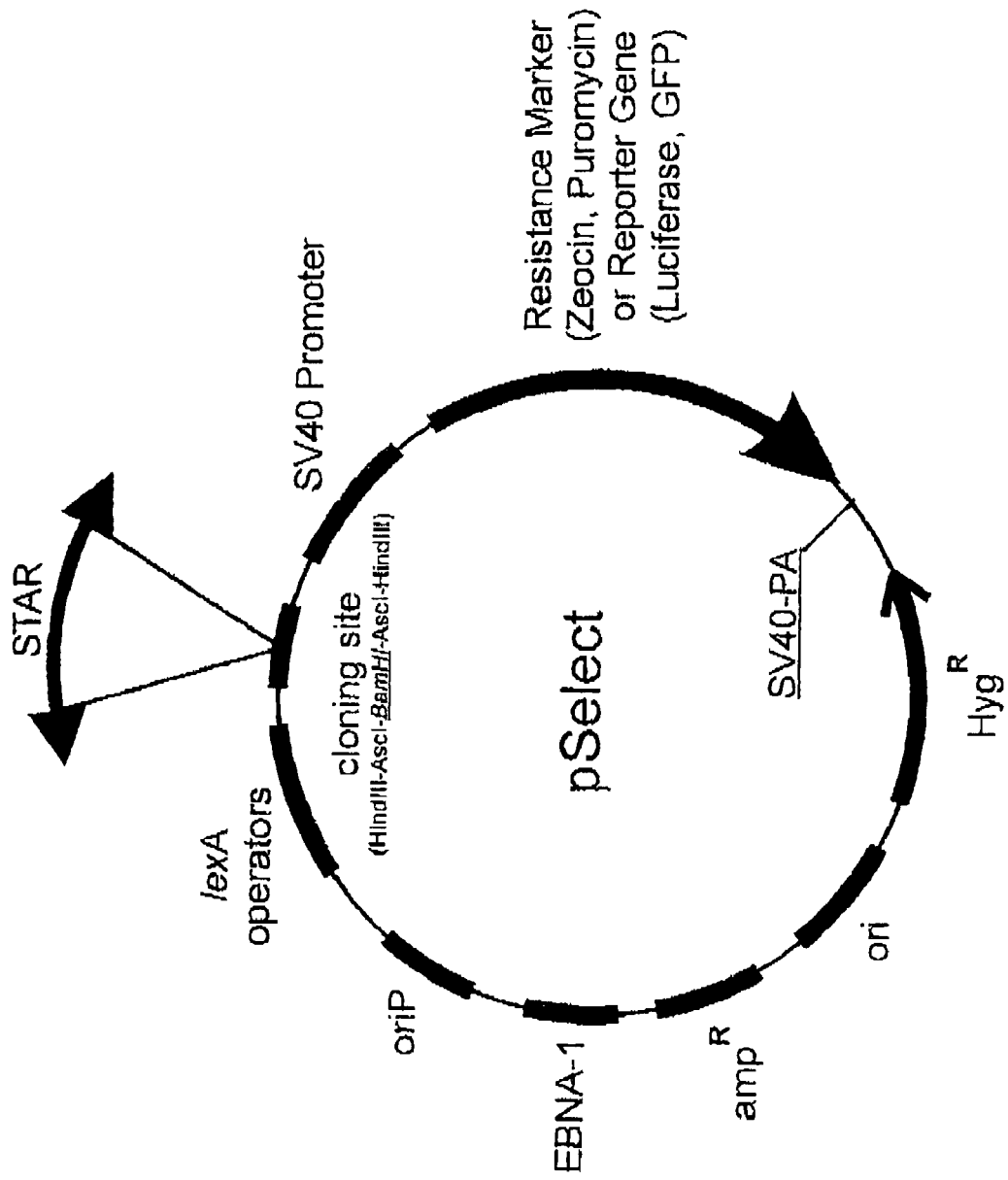
FIG. 1. The pSelect family of plasmids for selecting and characterizing STAR elements. A resistance marker (zeocin or puromycin) or reporter gene (GFP or luciferase) under control of the promiscuous SV40 promoter is adjacent to a BamHI cloning site flanked by AscI and HindIII sites. Upstream of the cloning site are lexA operators to which lexA protein can bind. Binding of chimeric lexA-Polycomb group proteins to the operators causes repression of the marker or reporter gene. DNA fragments inserted at the cloning site that block repression are identified by the persistent expression of the marker or reporter gene. The plasmid replicates episomally in cultured mammalian cells due to the oriP sequence.

In a preferred embodiment, the fragments are located between i) the element with a gene-transcription repressing quality, and ii) the promoter directing transcription of the reporter gene. RNA polymerase initiates the transcription process after binding to a specific sequence, called the "promoter", that signals where RNA synthesis should begin. A modulating quality can enhance transcription from the promoter in cis, in a given cell type and/or a given promoter. The same DNA sequence can comprise an enhancing quality in one type of cell or with one type of promoter, whereas it can comprise another or no gene transcription modulating quality in another cell or with another type of promoter. Transcription can be influenced through a direct effect of the regulatory element (or the protein(s) binding to it) on the transcription of a particular promoter. Transcription can however, also be influenced by an indirect effect, for instance because the regulatory element affects the function of one or more other regulatory elements.

A gene transcription modulating quality can also comprise a stable gene transcription quality. With "stable" is meant that the observed transcription level is not significantly changed over at least 30 cell divisions. A stable quality is useful in situations wherein expression characteristics should be predictable over many cell divisions. Typical examples are cell lines transfected with foreign genes. Other examples are transgenic animals and plants and gene therapies. Very often, introduced expression cassettes function differently after increasing numbers of cell divisions or plant or animal generations. In a preferred embodiment, a stable quality comprises a capacity to maintain gene transcription in subsequent generations of a transgenic plant or animal. Of course, in case expression is inducible the quality comprises the quality to maintain inducibility of expression in subsequent generations of a transgenic plant or animal. Frequently, expression levels drop dramatically with increasing numbers of cell divisions. With a method of the invention it is possible to detect and optionally select a DNA sequence that is capable of at least in part preventing the dramatic drop in transcription levels with increasing numbers of cell divisions. Thus, in a preferred embodiment the gene transcription modulating quality comprises a stable gene transcription quality. Strikingly, fragments comprising a DNA sequence with the stable gene transcription quality can be detected and optionally selected with a method of the invention, in spite of the fact that the method does not necessarily measure long term stability of transcription. In a preferred embodiment, of the invention the gene transcription modulating quality comprises a stable gene transcription enhancing quality. It has been observed that incorporation of a DNA sequence with a gene transcription modulating quality in an expression vector with a gene of interest, results in a higher level of transcription of the gene of interest, upon integration of the expression vector in the genome of a cell and moreover that the higher gene expression level is also more stable than in the absence of the DNA sequence with a gene transcription modulating quality.

In experiments designed to introduce a gene of interest into a cell's genome to obtain expression of a gene of interest, the following has been observed. If together with the gene of interest also a DNA sequence with a gene transcription modulating quality was introduced, more clones could be detected that expressed more than a certain amount of gene product of the gene of interest, than when the DNA sequence was not introduced together with the gene of interest. Thus, the present invention also provides a method for increasing the number of cells expressing a more than a certain level of a gene product of a gene of interest upon providing the gene of interest to the genome of the cells, comprising providing the cell with a DNA sequence comprising a gene transcription modulating quality together with the gene of interest.

The chances of detecting a fragment with a gene transcription-modulating quality vary with the source from which the fragments are derived. Typically, no prior knowledge exists of the presence or absence of fragments with the quality. In those situations, many fragments will not comprise a DNA sequence with a gene transcription-modulating quality. In these situations, a formal selection step for DNA sequences with the quality is introduced. This is done by selection vectors comprising the sequence on the basis of a feature of a product of the reporter gene that can be selected for or against. For instance, the gene product may induce fluorescence or a color deposit (e.g., green fluorescent protein and derivatives, luciferase, or alkaline phosphatase) or confer antibiotic resistance or induce apoptosis and cell death.

The invention is particularly suited for detecting and optionally selecting a DNA sequence comprising a gene transcription-enhancing quality. It has been observed that at least some of the selected DNA sequences, when incorporated into an expression vector comprising a gene of interest, can dramatically increase gene transcription of the gene of interest in a host cell even when the vector does not comprise an element with a gene-transcription repressing quality. This gene transcription enhancing quality is very useful in cell lines transfected with foreign genes or in transgenic animals and plants.

The transcription system can be a cell free in vitro transcription system. With the current expertise in automation such cell free systems can be accurate and quick. However, for the present invention, the transcription system preferably comprises host cells. Using host cells warrants that fragments are detected and optionally selected with activity in cells.

An element with a gene transcription repressing quality will, in a method of the invention, repress transcription from a promoter in the transcription system used. The repression does not have to lead to undetectable expression levels. Important is that the difference in expression levels in the absence or presence of repression is detectable and optionally selectable. In a preferred embodiment, gene-transcription repression in the vectors results in gene-transcription repressing chromatin. In this preferred embodiment, DNA sequences can be detected, and optionally selected that are capable of at least in part counteracting the formation of gene-transcription repressing chromatin. In one aspect a DNA sequence capable of at least in part counteracting the formation of gene-transcription repressing chromatin comprises a stable gene transcription quality. In a preferred embodiment, the DNA sequence involved in gene-transcription repression is a DNA sequence that is recognized by a protein complex and wherein the transcription system comprises the complex. Preferably, the complex comprises a heterochromatin-binding protein comprising HP1, a Polycomb-group (Pc-G) protein, a histone deacetylase activity or MeCP2 (methyl-CpG-binding protein). Many organisms comprise one or more of these proteins. These proteins frequently exhibit activity in other species as well. The complex can thus also comprise proteins from two or more species. The mentioned set of known chromatin-associated protein complexes are able to convey long-range repression over many base pairs. The complexes are also involved in stably transferring the repressed status of genes to daughter cells upon cell division. Sequences selected in this way are able to convey long-range anti-repression over many base pairs (van der Vlag et al., 2000).

The vector used can be any vector that is suitable for cloning DNA and that can be used in a transcription system. When host cells are used, it is preferred that the vector is an episomally replicating vector. In this way, effects due to different sites of integration of the vector are avoided. DNA elements flanking the vector at the site of integration can have effects on the level of transcription of the promoter and thereby mimic effects of fragments comprising DNA sequences with a gene transcription modulating quality. In a preferred embodiment, the vector comprises a replication origin from the Epstein-Barr virus (EBV), OriP, and a nuclear antigen (EBNA-1). Such vectors are capable of replicating in many types of eukaryotic cells and assemble into chromatin under appropriate conditions.

In another aspect the invention provides a DNA sequence comprising i) a DNA sequence isolated from a plant or vertebrate, or derivatives thereof, or ii) a synthetic DNA sequence or one constructed by means of genetic engineering, which DNA sequence is a repression-inhibiting sequence which, by the method according to the present invention can be detected, selected and optionally cloned. In another aspect the invention provides a DNA sequence comprising i) a DNA sequence isolated from a plant or vertebrate, or derivatives thereof, or ii) a synthetic DNA sequence or one constructed by means of genetic engineering, which DNA sequence is detected, selected and optionally cloned by means of the method of the invention. Preferably, the DNA sequence comprises a sequence as depicted in Table 4A (SEQ ID NOs:125–134) or a functional homologue thereof. A functional homologue of a sequence as depicted in Table 4 (SEQ ID NOs:125–140) is a sequence derived with the information given in Table 4 (be it table 4A (SEQ ID NOs:125–134) or table 4B (SEQ ID NOs: 135–140)). For instance, a sequence that can be derived from a sequence in Table 4 (SEQ ID NOs:125–140) by deleting, modifying and/or inserting bases in or from a sequence listed in Table 4 (SEQ ID NOs:125–140), wherein the derived sequence comprises the same activity in kind, not necessarily in amount, of a sequence as depicted in Table 4 (SEQ ID NOs:125–140). A functional homologue is further a sequence comprising a part from two or more sequences depicted in Table 4 (SEQ ID NOs:125–140). A synthetic DNA sequence is a sequence that is not derived directly or indirectly from a sequence present in an organism. For instance a sequence comprising a *drosophila* scs or scs' sequence is not a synthetic sequence, even when the scs or scs' sequence was artificially generated.

In one aspect, the invention is concerned with increasing knowledge of higher order gene regulation and with means and methods for utilizing this knowledge. Whereas elements, such as classical promoters and enhancers, have been characterized that direct and regulate transcription of single genes, higher order regulatory elements that govern the gene transcription capabilities of entire chromosome regions have as yet received little attention. Much of our knowledge regarding such higher order elements comes from the study of embryogenesis. During embryogenesis cells become committed to different developmental pathways. Once committed, cells rarely change their fates, even after many cell divisions.

It has become increasingly clear that the stable transmission of cell type specific gene transcription patterns is not dependent on the context of a promoter, but is instead mediated by changes in the structure of the DNA and associated proteins, termed chromatin. Gene regulation at the chromosomal level involves modifications of DNA (e.g., methylation), histones, (e.g., acetylation and/or methylation), and long-range interactions between distant chromosomal elements.

The chromatin template is a highly condensed complex of DNA, histones, and non-histone proteins, which is able to package the entire genome into the nucleus and simultaneously allow the appropriate transcription of specific genes. The eukaryotic chromosome is not a uniform template for the activation of gene transcription. Different types of chromatin and chromatin regions can be distinguished, which differentially affect gene transcription. The so-called heterochromatin regions identify 'closed' chromatin structures whereas euchromatin is associated with a more diffuse and 'open' chromatin structure. The euchromatin region can be subject to structural changes, resulting in more or less condensed structures, referred to as facultative heterochromatin and euchromatin. The formation of facultative euchromatin or heterochromatin is believed to represent the underlying mechanism of chromatin-mediated gene regulation, keeping genes in an active or a repressed state, in a cell type specific manner.

In all eukaryotes several chromatin-associated protein complexes have been identified that are involved in the maintenance of cell type specificity, one of which is the Polycomb group (PcG) complex. The PcG complex is involved in the stable repression of genes, in which changes in chromatin structure are believed to play an important role. Similarly, a second class of proteins, named the trithorax group (TrG), has been identified that counteracts the action of the PcG proteins. TrG proteins are involved in the maintenance of gene transcription. Based on their respective modes of action, PcG and TrG proteins therefore represent a cellular memory system that is important for the heritable transmission of gene transcription patterns.

How PcG and TrG complexes are associated with their target genes is still unclear. Genetic studies have characterized cis-acting regulatory sequences that maintain transcriptionally inactive states of genes. The silencing mediated by these cis-acting regulatory sequences is dependent on the presence of functional PcG proteins, and hence these sequences have been termed PcG response elements (PREs). Sequences have been identified that are involved in PcG mediated repression of chromatin. As yet, however, (in both vertebrates or plants) complete PREs comprising all sequence information required to mediate repression of chromatin have not been found.

In addition, it has, as yet, not been possible to study sequences with long range repression capabilities in a coherent way. This is for a large part due to the inability to systematically screen for such long-range acting sequences. In one aspect the invention provides means and methods for systematically detecting such sequences in DNA. In one embodiment, the invention provides a method for identifying a DNA sequence with a gene transcription repressing quality comprising,
  providing a collection of test nucleic acids,
  generating a collection of expression vectors comprising test nucleic acids and a first reporter gene under transcriptional control of a promoter,
  providing cells with the collection of expression vectors,
  selecting a cell or vector-containing progeny thereof, wherein transcription of the first reporter gene is repressed, and
  identifying the test nucleic acid in the cell. The identified test nucleic acid comprises the capacity to repress the promoter function and thus comprises a gene transcription repressing quality.

Preferably, the identified test nucleic acid is also retrieved and cloned. The quality comprises at least in part, the capacity to reduce the level of transcription from the promoter when physically linked to the promoter, compared to the level in the absence of the DNA sequence with the quality. In a preferred embodiment, the gene transcription repressing quality comprises a gene transcription repressing chromatin quality, i.e., wherein the reduction of the level of transcription is the result of chromatin having a gene transcription repressing configuration. This configuration preferably encompasses the promoter. However, it is also possible that the configuration encompasses an enhancer or the like thereby at least in part inactivating the transcription enhancing effect of the enhancer on the promoter. In a particularly preferred embodiment, the DNA sequence with a gene transcription repressing chromatin quality comprises a polycomb-group-like responsive element.

Using the methods described herein, it is possible to retrieve several nucleic acid sequences comprising the capacity to reduce the level of transcription from a promoter and thus nucleic acid sequences comprising a gene transcription repressing quality. Sequences with analogous function can be compared with each other for sequence similarities such that one or more consensus sequences for elements with a gene transcription repressing quality such as polycomb-group-like responsive elements, can be deduced. Moreover, considering that entire sequences of organismal genomes are known and more will follow shortly, it is possible to screen these genomes or parts thereof, and predict the occurrence of these sequences in the genome. Knowledge of the occurrence and localization of DNA sequences comprising gene transcription-modulating qualities and/or gene transcription repressing qualities in the genome will greatly increase our knowledge of higher order regulation of gene transcription in the genome.

A Polycomb-group response element is an element that is capable of repressing the transcription from a promoter in response to the direct and/or indirect interaction of one or more Polycomb group proteins with the element. A polycomb-group-like response element is a Polycomb-group response element or alternatively it is an element capable of repressing the transcription of a promoter upon the direct and/or indirect interaction of one or more proteins with the element, wherein the one or more proteins do not belong to the Polycomb-group, but wherein as a result of the interaction gene transcription repressing chromatin is formed. Examples of such proteins are chromatin-associated proteins such as heterochromatin protein1 (HP1) (Eisenberg et al., 1990) Another chromatin-associated protein that represses gene activity is methyl-CpG-binding protein, MeCP2 (Nan et al., 1997). In a preferred embodiment, a polycomb-group-like responsive element of the invention comprises the capacity to repress transcription of a promoter over long distances, preferably over more than 2000 base pairs (van der Vlag et al., 2000).

A collection of test nucleic acids can be generated in many ways. Using artificial sequences as test nucleic acids it is possible to obtain a consensus sequence for a gene transcription repressing quality. Different qualities can comprise different consensus sequences. Preferably, the collection is generated from chromosomal DNA. In this way, a gene transcription repressing quality comprising a sequence occurring naturally in the chromosome is found. This has the advantage that the location of these qualities in the chromosome can be determined whereupon their influence on higher order gene transcription in the location can be resolved.

A reporter gene is a gene encoding an expression product of which the presence can be detected directly or indirectly in a cell. In methods for detecting a gene transcription repressing quality, the transfer of an expression vector into a cell will lead to expression of the reporter gene. However, in case test nucleic acid comprises a gene transcription repressing quality, such as a polycomb-group-like responsive element, expression will be repressed in the cell thereby leading to an at least in part reduced expression of the reporter gene. The presence or absence of a nucleic acid capable of repressing transcription of the promoter can thus be detected by detecting the expression product in the cell, whereby reduced detection or no detection indicates the presence of a gene transcription repressing quality. A reporter gene can encode a fluorescent reporter protein. Reduced expression can then be detected by fluorometric means for instance in a flow cytometer. Cells displaying no or low fluorescence can be sorted using a fluorescence activated cell sorter and the expression vector and/or the test nucleic acid isolated, for instance by means of an amplification reaction. Preferably, the first reporter gene comprises a selectable reporter gene, the expression of which directly or indirectly provides the cell with at least a growth disadvantage over cells not expressing or expressing low levels of the first reporter gene. In cases where DNA sequences with a gene-transcription repressing quality are screened for, expression of the first reporter gene is, preferably, directly or indirectly toxic to the cell. Non-limiting examples of such a toxic expression product is ricin or toxic variants thereof. In another example, the first reporter gene encodes an apoptosis inducing gene product. Preferably, the apoptosis inducing gene product comprises adenovirus 13S E1A or a functional equivalent thereof (Breckenridge and Shore, 2000). In another embodiment, the apoptosis inducing gene product comprises apoptin or a functional equivalent thereof (Pietersen and Noteborn, 2000).

Another example is a gene encoding a so-called suicide product such as the herpes simplex virus thymidine kinase (HSV-tk). Addition of gancyclovir to cultures of cells expressing HSV-tk will result in the formation of a toxic substance in these cells and therefore kill these cells. In a particularly preferred embodiment, the suicide gene comprises cytosine deaminase. Cytosine deaminase converts cytosine to uracil. This enzyme activity is found in prokaryotes and lower eukaryotes, but is absent in higher eukaryotes. The gene is used as a metabolic suicide gene in combination with the prodrug 5-fluorocytosine (5-FC). Cytosine deaminase is able to convert the non-toxic 5-FC into 5-fluorouracil, which kills cells by disrupting DNA synthesis, thereby triggering apoptosis (Mullen et al., 1992; Wei and Huber, 1996).

A promoter controlling transcription of the first reporter gene can be any promoter that is active, or can be activated in the cells. By selecting a particular promoter, it is possible to select a gene transcription repressing quality such as a polycomb-group-like responsive element capable of repressing transcription of the particular promoter. In this way, it is possible to select qualities that specifically repress the class of promoters the particular promoter belongs to. In a preferred embodiment, the promoter comprises a promoter of which the activity can be induced upon providing a cell comprising the promoter with a signal. Such an inducible promoter preferably comprises a tetracycline responsive promoter. The signal here being tetracycline, doxycycline and equivalent compounds. Such promoters can also be adapted for tetracycline responsiveness in eukaryotic cells (Yin et al., 1996). Promoters and transacting molecules are available that either induce or repress expression of a gene, upon the addition of tetracycline or equivalents thereof.

Cells transfected with an expression vector of the invention can, with a typically low frequency and for reasons not associated with the presence of a DNA sequence with a gene transcription repressing quality, not express detectable amounts of expression product of the first reporter gene. This can, for instance, be due to a recombination event disrupting the coding sequence of the first reporter gene. In a preferred embodiment, of the invention the collection of expression vectors further comprises a second reporter gene. Expression of the second reporter gene is preferably under the control of a second promoter. Methods for the detection of expression of an expression product of the second reporter gene can be used to confirm the expression repressing activity of the test nucleic acid, thereby at least in part reducing the number of cells falsely not expressing the first reporter gene. In a preferred embodiment, the second reporter gene is used to select for cells comprising an expression cassette. In this way, cells not comprising the expression cassette can easily be disregarded. To this end the expression product of the second reporter gene preferably comprises a positive dominant selectable reporter gene. Preferably, the positive dominant selectable reporter gene encodes an expression product capable of conferring resistance to an otherwise toxic compound. Non-limiting examples are G418 resistance and hygromycin resistance.

Considering that a gene transcription repressing quality can suppress transcription it is preferred that in this embodiment an expression vector further comprises at least one DNA sequence with a gene transcription modulating quality, capable of counteracting transcription repressing effects of a DNA sequence with a gene transcription repressing quality. The placement of the transcription counteracting element in the expression vector is preferably such that it effectively interferes with a reducing effect of the gene transcription repressing quality could have on the level of transcription of the second reporter gene. In a preferred embodiment, the DNA sequence with a gene transcription modulating quality functionally separates the expression cassettes comprising the first and the second reporter gene. Preferably, the second reporter gene (and promoter controlling transcription of the second reporter gene) is flanked by DNA sequences with a gene transcription modulating quality. Examples of DNA sequences with a gene transcription modulating quality are the so-called STAR elements listed in Tables 1 (SEQ ID NOs:6, 3, 8, 4 and 1) and 2 (SEQ ID NOs:1–17).

Methods of the invention result in the cloning and identification of a number of elements comprising a gene transcription modulating and/or a gene transcription repressing quality. Such an element may contain irrelevant nucleic acid that is not instrumental in performing the quality, for instance not involved in the formation of gene-transcription repressing chromatin. Functional sequences in such elements can be delineated by various methods known in the art. In one embodiment, deletions and/or substitutions are made in a DNA sequence with a gene transcription modulating or a gene transcription repressing quality. DNA that is modified in such a way, is tested for activity in a method of the invention. This can be done using a single modified nucleic acid or by generating a collection of test nucleic acids comprising the modified nucleic acid. Elucidation of functional sequences within DNA sequences of the invention enables the elucidation of consensus sequences for elements with a gene transcription modulating and/or a gene transcription repressing quality. Considering that there are several polycomb-group-like complexes that each comprise different functionalities and expression patterns, it is anticipated that more than one type of consensus sequence is found with a method of the invention.

Analogously, it is anticipated that more than one type of consensus sequence is found for an element comprising a gene transcription modulating quality. The invention thus further provides a library of isolated and/or recombinant nucleic acids comprising gene transcription modulating and/ or gene transcription repressing qualities such as polycomb-group-like response elements. In one embodiment, the library comprises isolated and/or recombinant nucleic acids comprising the same consensus sequence. In a preferred embodiment, the library comprises more than one type of consensus sequence. The library can be used for instance for determining whether a given DNA molecule comprises a DNA modulating quality. In a preferred embodiment, the library comprises essentially all elements with a gene transcription enhancing function, elements comprising a stable gene transcription quality and/or elements with a gene transcription repressing quality such as polycomb-group-like response elements, of a chromosome. Together with knowledge on the location of these elements on a chromosome this allows a person skilled in the art to generate a prediction for higher order regulation of gene expression of genes naturally present on the chromosome and for genes (foreign nucleic acid) introduced into the chromosome by recombinant means. Such a prediction can be used for example to select a suitable candidate location on the chromosome for the insertion of foreign DNA. A suitable location can be a location expected to be specifically expressed in a certain cell, cell type and/or tissue. Preferably, the chromosome comprises chromosome 21 or chromosome 22.

In a particularly preferred embodiment, all DNA sequences comprising a gene transcription modulating or a gene transcription repressing quality in a cell, are in the library. In this embodiment the entire genome can be used for the prediction of a suitable candidate location. In one embodiment, the library has been generated in different cell lines of species ranging from plants to human. In different cell lines and/or species different proteins (or protein complexes) capable of interacting with DNA sequences with a gene transcription repressing quality, will be expressed, resulting in different DNA elements with a gene transcription repressing quality. Similarly different proteins that interact directly or indirectly with DNA sequences comprising a gene transcription modulating quality will be expressed. Therefore the make-up of the library is cell-type dependent and dependent on the presence of the relevant proteins. This is also the case with polycomb-group-like response elements. If HP1 is expressed in cell type one, elements depending on HP1 will be detected by method of invention. If HP1 is not expressed in cell type two, method of invention will not detect the element that has been retrieved from cell type one.

In one aspect of the invention, the library comprises at least one element capable of at least in part counteracting the formation of gene-transcription repressing chromatin. Together with knowledge of the location of DNA sequences with a gene transcription repressing quality on a chromosome or genome, knowledge of the location of such counteracting elements allows more accurate prediction of higher order regulation of gene transcription of (inserted) genes in the chromosome or genome. Preferably, the library further comprises other transcription regulatory elements such as enhancers and silencers. Although such sequences have limited influence on higher order gene regulation, information on the location of such other sequences further increases the accuracy of the prediction on suitable locations in the genome for the expression of foreign sequences introduced therein. Preferably, the library comprises essentially all DNA sequences comprising a gene transcription modulating quality and/or all other regulatory sequences of a chromosome.

Considering that a chromosome already typically contains several tens of millions of bases, it is preferred that the information that the library can give on higher order gene regulation is incorporated into an at least partially automated system.

Another use of a library of the invention is the generation of a prediction on transcription of genes upon targeted modification of sequences on a chromosome such that "higher order" regulatory sequences are mutated. For instance, one or more polycomb-group-like responsive elements of the invention, and/or other regulatory elements on the chromosome can be mutated. This is expected to change the transcription levels of the genes that are in the vicinity of the polycomb-group-like responsive elements and/or other expression modulating elements.

Yet another use of a library or system of the invention is the prediction of gene expression resulting from mutations in the genome. In cases where a mutation results in altered gene transcription, detection of such altered gene transcription can indicate the presence of the naturally occurring mutation. This approach is useful for instance in limiting the number of sequences or proteins to be tested in a diagnostic assay. This is particularly important in microarray approaches because in these approaches the number of expressed sequences to be tested for, is limited by the number of sequences that an array can maximally hold. With means and methods of the invention it is possible to limit the number of sequences to be tested in microarray approaches.

Yet another use of a system or library of the invention is the discovery of drug targets. Regulatory elements, be they "higher order" elements or not, function because of the protein (complexes) that can bind to them. A system of the invention can be used to determine whether targeting of drugs to interfere with the binding or function of a particular protein (complex) holds promise for the alteration of expression of a particular gene.

The invention further provides a DNA sequence comprising a gene-transcription repressing quality obtainable by a method of the invention. In a preferred embodiment, the DNA sequence comprising a gene-transcription repressing quality is derived from a vertebrate of a plant. More preferably, the DNA sequence comprising a gene-transcription repressing quality comprises a sequence according to table 4B (SEQ ID Nos:135–140), or a functional homologue thereof. It is also possible to provide a DNA construct with a DNA sequence of the invention, or to modify such a DNA sequence. In a preferred embodiment, a DNA construct is provided comprising a promoter operably linked with a nucleic acid of interest. Preferably, the amount of activity of a quality of the DNA sequence with a gene transcription modulating and/or repressing quality, is dependent on the orientation of the DNA sequence in the construct, compared to the promoter. Preferably, the gene transcription modulating and/or repressing quality is dependent on the presence of a signal. Preferably, the signal comprises a DNA binding protein. Preferably, the signal comprises a human immunodeficiency virus TAT protein.

One of the uses of a DNA sequence comprising a gene transcription modulating quality or a gene transcription repressing quality is of course the regulation of transcription of a gene of interest. Transcription of a gene of interest can be altered by altering sequences in the vicinity of the gene such that a DNA sequence with the quality is provided or removed. Specific expression characteristics can be designed by combining (parts of) DNA sequences with a gene transcription modulating and/or a gene transcription repressing quality. For instance, duplication of a sequence with a stable gene transcription quality in an expression vector will lead to improved stability of expression in a target cell or progeny upon introduction of the vector in the target cell. By combining DNA sequences with gene transcription modulating qualities altered gene transcription modulating qualities can be generated either in kind or amount or both.

It is also possible to design DNA sequences with a desired gene transcription modulating and/or a gene transcription repressing quality. DNA binding proteins together with other proteins and DNA sequences determine qualities of the DNA sequence. It is possible to insert one or more other protein binding DNA sequences into a DNA sequence with a quality. By allowing binding of the binding protein(s) it is possible to interfere with, or direct, the quality, thus allowing the generation of DNA sequences with designer qualities. It is also possible to remove protein binding sites from a DNA sequence with a particular gene transcription modulating and/or a gene transcription repressing quality thereby altering the quality of the resulting DNA sequences. The combination of addition and removal is also possible. Particular gene transcription modulating and/or gene transcription repressing qualities can be selected for by tuning detection methods described in the present invention. It is for instance possible to synthesize DNA sequences with inducible gene transcription modulating and/or gene transcription repressing qualities. By for instance including TAT-binding elements in a DNA sequence comprising a gene-transcription repressing quality, it is possible to at least in part inactivate the gene-transcription repressing quality in a cell comprising TAT. Similarly, there are DNA binding proteins available that only bind to their target sequence in the absence or presence of a signal. Non-limiting examples of such proteins are the TET-repressor and the various mutations thereof, the lac-repressor, steroid hormone receptors, the retinoic acid receptor, and derivatives. It is possible for instance to design a DNA sequence with a cell type specific gene transcription modulating and/or a gene transcription repressing quality. For instance, in case of the above mentioned TAT example. The referred to DNA sequence can be made specific for HIV infected cells that express TAT. Alternatively, The DNA sequence can be made specific for a protein complex that is expressed in a cell type specific fashion.

Expression constructs comprising a DNA sequence comprising a gene transcription modulating and/or gene transcription repressing quality are suitable for obtaining expression from the construct in cells comprising more than one copy of the expression construct. Also when the expression construct is present in the genome of the cell and, also when the expression cassette is present in more than one copy in the cell. Moreover, they even work when integrated into the same position in more than one copy.

In a preferred embodiment of the invention, the DNA sequence with a gene transcription modulating quality comprises a so-called STAR (Stabilizing Anti-Repression) sequence. A STAR sequence as used herein refers to a DNA sequence comprising one or more of the mentioned gene transcription modulating qualities.

Several methods are available in the art to extract sequence identifiers from a family of DNA sequences sharing a certain common feature. Such sequence identifiers can subsequently be used to identify sequences that share one or more identifiers. Sequences sharing such one or more identifiers are likely to be a member of the same family of sequences, i.e., are likely to share the common feature of the family. In the present application a large number of sequences comprising STAR activity (so-called STAR sequences) were used to obtain sequence identifiers (patterns) which are characteristic for sequences comprising STAR activity. These patterns can be used to determine whether a test sequence is likely to contain STAR activity. In one aspect, the invention thus provides a method for detecting the presence of a STAR sequence within a nucleic acid sequence of about 50–5000 base pairs, comprising determining the frequency of occurrence in the sequence of at least one sequence pattern and determining that the frequency of occurrence is representative of the frequency of occurrence of the at least one sequence pattern in at least one sequence comprising a STAR sequence. In principle, any method is suited for determining whether a sequence pattern is representative of a STAR sequence. Many different methods are available in the art. In a preferred embodiment, of the invention the step of determining that the occurrence is representative of the frequency of occurrence of the at least one sequence pattern in at least one sequence comprising a STAR sequence comprises, determining that the frequency of occurrence of the at least one sequence pattern significantly differs between the at least one STAR sequence and at least one control sequence. In principle, any significant difference is discriminative for the presence of a STAR sequence. However, in a particularly preferred embodiment the frequency of occurrence of the at least one sequence pattern is significantly higher in the at least one sequence comprising a STAR sequence compared to the at least one control sequence.

A considerable number of sequences comprising a STAR sequence have been identified in the present invention. It is possible to use these sequences to test how efficient a pattern is in discriminating between a control sequence and a sequence comprising a STAR sequence. Using so-called "discriminant analysis" it is possible to determine on the basis of any set of STAR sequences in a species, the most optimal discriminative sequence patterns or combination thereof. Thus, preferably, at least one of the patterns is selected on the basis of a desired, and, preferably, an optimal discrimination between the at least one sequence comprising a STAR sequence and a control sequence. A desired discrimination can be a certain significance factor associated with the pattern through bioinformatics.

In a preferred embodiment, the frequency of occurrence of a sequence pattern in a test nucleic acid is compared with the frequency of occurrence in a sequence known to contain a STAR sequence. In this case, a pattern is considered representative for a sequence comprising a STAR sequence if the frequencies of occurrence are similar. In a preferred embodiment, another criterion is used. The frequency of occurrence of a pattern in a sequence comprising a STAR sequence is compared to the frequency of occurrence of the pattern in a control sequence. By comparing the two frequencies it is possible to determine for each pattern thus analysed, whether the frequency in the sequence comprising the STAR sequence is significantly different from the frequency in the control sequence. In this embodiment, a sequence pattern is considered to be representative of a sequence comprising a STAR sequence, if the frequency of occurrence of the pattern in at least one sequence comprising a STAR sequence is significantly different from the frequency of occurrence of the same pattern in a control sequence. By using larger numbers of sequences comprising a STAR sequence the number of patterns for which a statistical difference can be established increases, thus enlarging the number of patterns for which the frequency of occurrence is representative for a sequence comprising a STAR sequence. Preferably, the frequency of occurrence is representative of the frequency of occurrence of the at least one sequence pattern in at least 2 sequences comprising a STAR sequence, more preferably in at least 5 sequences comprising a STAR sequence, more preferably, in at least 10 sequences comprising a STAR sequence. More preferably, the frequency of occurrence is representative of the frequency of occurrence of the at least one sequence pattern in at least 20 sequences comprising a STAR sequence. In a particularly preferred embodiment, the frequency of occurrence is representative of the frequency of occurrence of the at least one sequence pattern in at least 50 sequences comprising a STAR sequence.

The patterns that are indicative for a sequence comprising a STAR sequence are also dependent on the type of control nucleic acid used. The type of control sequence used is preferably selected on the basis of the sequence in which the presence of a STAR sequence is to be detected. In a preferred embodiment, the control sequence comprises a random sequence comprising a similar AT/CG content as the at least one sequence comprising a STAR sequence. In another preferred embodiment, the control sequence is derived from the same species as the sequence comprising the STAR sequence. For instance, if a test sequence is scrutinized for the presence of a STAR sequence, active in a plant cell, then preferably the control sequence is also derived from a plant cell. Similarly, for testing for STAR activity in a human cell, the control nucleic acid is preferably also derived from a human genome. In a preferred embodiment, the control sequence comprises between 50% and 150% of the bases of the at least one sequence comprising a STAR sequence. In a particularly preferred embodiment, the control sequence comprises between 90% and 110% of the bases of the at least one sequence comprising a STAR sequence; more preferably, between 95% and 105%.

A pattern can comprise any number of bases larger than two. Preferably, at least one sequence pattern comprises at least 5, more preferably at least 6 bases. In another embodiment, at least one sequence pattern comprises at least 8 bases. In a preferred embodiment, the at least one sequence pattern comprises a pattern listed in table 9 and/or table 10. A pattern may consist of a consecutive list of bases. However, the pattern may also comprise bases that are interrupted one or more times by a number of bases that are not or only partly discriminative. A partly discriminative base is for instance indicated as a purine.

Preferably, the presence of STAR activity is verified using a functional assay. Several methods are presented herein to determine whether a sequence comprises STAR activity. STAR activity is confirmed if the sequence is capable of performing at least one of the following functions: (i) at least in part inhibiting the effect of sequence comprising a gene transcription repressing element of the invention, (ii) at least in part blocking chromatin-associated repression, (iii) at least in part blocking activity of an enhancer, (iv) conferring upon an operably linked nucleic acid encoding a transcription unit compared to the same nucleic acid alone. (iv-a) a higher predictability of transcription, (iv-b) a higher transcription, and/or (iv-c) a higher stability of transcription over time.

The large number of sequences comprising STAR activity identified in the present invention opens up a wide variety of possibilities to generate and identify sequences comprising the same activity in kind not necessarily in amount. For instance, it is well within the reach of a skilled person to alter the sequences identified in the present invention and test the altered sequences for STAR activity. Such altered sequences are therefore also part of the present invention. Alteration can include deletion, insertion and mutation of one or more bases in the sequences.

Sequences comprising STAR activity were identified in stretches of 400 bases. However, it is expected that not all of these 400 bases are required to retain STAR activity. Methods to delimit the sequences that confer a certain property to a fragment of between 400 and 5000 bases are well known. The minimal sequence length of a fragment comprising STAR activity is estimated to be about 50 bases.

Table 9 (SEQ ID NOs:184–349) and Table 10 (SEQ ID NOs:350–1079) list patterns of 6 bases that have been found to be over represented in nucleic acid molecules comprising STAR activity. This over-representation is considered to be representative for a STAR sequence. The tables were generated for a family of 65 STAR sequences. Similar tables can be generated starting from a different set of STAR sequences, or from a smaller or larger set of STAR sequences. A pattern is representative for a STAR sequence if it is over represented in the STAR sequence compared to a sequence not comprising a STAR element. This can be a random sequence. However, to exclude a non relevant bias, the sequence comprising a STAR sequence is preferably compared to a genome or a significant part thereof. Preferably, it is compared to a genome of a vertebrate or plant, more preferably a human genome. A significant part of a genome is for instance a chromosome. Preferably, the sequence comprising a STAR sequence and the control sequence are derived from nucleic acid of the same species.

The more STAR sequences are used for the determination of the frequency of occurrence of sequence patterns, the more representative for STARs the patterns are that are over- or under-represented. Considering that many of the functional features that can be expressed by nucleic acids, are mediated by proteinaceous molecules binding to it, it is preferred that the representative pattern is over-represented in the STAR sequences. Such an over-represented pattern can be, part of, a binding site for such a proteinaceous molecule. Preferably, the frequency of occurrence is representative of the frequency of occurrence of the at least one sequence pattern in at least 2 sequences comprising a STAR sequence, more preferably in at least 5 sequences comprising a STAR sequence; more preferably in at least 10 sequences comprising a STAR sequence. More preferably, the frequency of occurrence is representative of the frequency of occurrence of the at least one sequence pattern in at least 20 sequences comprising a STAR sequence. In a particularly preferred embodiment, the frequency of occurrence is representative of the frequency of occurrence of the at least one sequence pattern in at least 50 sequences comprising a STAR. Preferably, the sequences comprising a STAR sequence comprises at least one of the sequences depicted in FIG. 26 (SEQ ID NOs:1–119).

STAR activity is feature shared by the sequences listed in FIG. 26 (SEQ ID NOs:1–119). However, this does not mean that they must all share the same identifier sequence. It is very well possible that different identifiers exist. Identifiers may confer this common feature onto a fragment containing it, though this is not necessarily so.

By using more sequences having STAR activity for determining the frequency of occurrence of a sequence pattern or patterns, it is possible to select patterns that are more often than others present or absent in such a STAR sequence. In this way it is possible to find patterns that are very frequently over or under represented in STAR sequences. Frequently over or under represented patterns are more likely to identify candidate STAR sequences in test sets. Another way of using a set of over or under represented patterns is to determine which pattern or combination of patterns is best suited to identify a STAR in a sequence.

Using so-called "discriminative statistics" we have identified a set of patterns which performs best in identifying a sequence comprising a STAR element. In a preferred embodiment, at least one of the sequence patterns for detecting a STAR sequence comprises a sequence pattern GGACCC (SEQ ID NO:194), CCCTGC (SEQ ID NO:213), AAGCCC (SEQ ID NO:277), CCCCCA (SEQ ID NO:305) and/or AGCACC (SEQ ID NO:343). In another embodiment, at least one of the sequence patterns for detecting a STAR sequence comprises a sequence pattern CCCN{16}AGC (SEQ ID NO:422), GGCN{9}GAC (SEQ ID NO:543), CACN{13}AGG (SEQ ID NO:768), CTGN{4}GCC (SEQ ID NO:846).

A list of STAR sequences can also be used to determine one or more consensus sequences therein. The invention therefore also provides a consensus sequence for a STAR element. This consensus sequence can, of course, be used to identify candidate STAR elements in a test sequence.

Moreover, once a sequence comprising a STAR element has been identified in a vertebrate it can be used by means of sequence homology to identify sequences comprising a STAR element in other species belonging to vertebrate. Preferably, a mammalian STAR sequence is used to screen for STAR sequences in other mammalian species. Similarly, once a STAR sequence has been identified in a plant species it can be used to screen for homologous sequences with similar function in other plant species. The invention in one aspect provides a STAR sequence obtainable by the method according to the invention. Further provided is a collection of STAR sequences. Preferably, the STAR sequence is a vertebrate or plant STAR sequence. More preferably, the STAR sequence is a mammalian STAR sequence or an angiosperm (monocot, such as rice or dicot such as *Arabidopsis*). More preferably, the STAR sequence is a primate and/or human STAR sequence.

A list of sequences comprising STAR activity can be used to determine whether a test sequence comprises a STAR element. There are, as mentioned above, many different methods for using such a list for this purpose. In a preferred embodiment, the invention provides a method for determining whether a nucleic acid sequence of about 50–5000 base pairs comprises a STAR sequence the method comprising, generating a first table of sequence patterns comprising the frequency of occurrence of the patterns in a collection of STAR sequences of the invention, generating a second table of the patterns comprising the frequency of occurrence of the patterns in at least one reference sequence, selecting at least one pattern of which the frequency of occurrence differs between the two tables, determining, within the nucleic acid sequence of about 50–5000 base pairs, the frequency of occurrence of at least one of the selected patterns, and determining whether the occurrence in the test nucleic acid is representative of the occurrence of the selected pattern in the collection of STAR sequences. Alternatively, the determining comprises determining whether the frequency of occurrence in the test nucleic acid is representative of the frequency of occurrence of the selected pattern in the collection of STAR sequences. Preferably, the method further comprises determining whether the candidate STAR comprises a gene transcription modulating quality using a method of the invention. Preferably, the collection of STARS comprises sequence as depicted in FIG. 26 (SEQ ID NOs:1–119).

In another aspect the invention provides an isolated and/or recombinant nucleic acid sequence comprising a STAR sequence obtainable by a method of the invention.

As mentioned previously herein, a STAR sequence can exert its activity in a directional way, i.e., more to one side of the fragment containing it than to the other. Moreover, STAR activity can be amplified in amount by multiplying the number of STAR elements. The latter suggests that a STAR element may comprise one or more elements comprising STAR activity. Another way of identifying a sequence capable of conferring STAR activity on a fragment containing it comprises selecting from a vertebrate or plant sequence, a sequence comprising STAR activity and identifying whether sequences flanking the selected sequence are conserved in another species. Such conserved flanking sequences are likely to be functional sequences. In one aspect, the invention therefore provides a method for identifying a sequence comprising a STAR element comprising selecting a sequence of about 50 to 5000 base pairs from a vertebrate or plant species comprising a STAR element and identifying whether sequences flanking the selected sequence in the species are conserved in at least one other species. The invention therefore further provides a method for detecting the presence of a STAR sequence within a nucleic acid sequence of about 50–5000 base pairs, comprising identifying a sequence comprising a STAR sequence in a part of a chromosome of a cell of a species and detecting significant homology between the sequence and a sequence of a chromosome of a different species. Preferably, the species comprises a plant or vertebrate species, preferably a mammalian species. The invention also provides a method for detecting the presence of a STAR element within a nucleic acid sequence of about 50–5000 base pairs of a vertebrate or plant species, comprising identifying whether a flanking sequence of the nucleic acid sequence is conserved in at least one other species.

It is important to note that methods of the invention for detecting the presence of a sequence comprising a STAR sequence using bioinformatical information are iterative in nature. The more sequences comprising a STAR sequence are identified with a method of the invention the more patterns are found to be discriminative between a sequence comprising a STAR sequence and a control sequence. Using these newly found discriminative patterns more sequences comprising a STAR sequence can be identified which in turn enlarges the set of patterns that can discriminate and so on. This iterative aspect is an important aspect of methods provided in the present invention.

The term "quality" in relation to a sequence refers to an activity of the sequence. The term "STAR", "STAR sequence" or "STAR element", as used herein, refers to a DNA sequence comprising one or more of the mentioned gene transcription modulating qualities. The term "SINC" or "SINC element" as listed below refers to a DNA sequence comprising one or more of the mentioned gene transcription repressing qualities. The term "DNA sequence" as used herein does, unless otherwise specified, not refer to a listing of specific ordering of bases but rather to a physical piece of DNA. A transcription quality with reference to a DNA sequence refers to an effect that the DNA sequence has on transcription of a gene of interest. "Quality" as used herein refers to detectable properties or attributes of a nucleic acid or protein in a transcription system.

The invention is further explained by the use of the following illustrative examples.

EXAMPLES

Example 1

Methods to Isolate STAR and SINC Elements

Materials and Methods

Plasmids and strains. The selection vector for STAR elements, pSelect-SV40-zeo ("pSelect", FIG. 1) is constructed as follows: the pREP4 vector (Invitrogen V004-50) is used as the plasmid backbone. It provides the Epstein Barr oriP origin of replication and EBNA-1 nuclear antigen for high-copy episomal replication in primate cell lines; the hygromycin resistance gene with the thymidine kinase promoter and polyadenylation site, for selection in mammalian cells; and the ampicillin resistance gene and colE1 origin of replication for maintenance in *Escherichia coli*. The vector contains four consecutive LexA operator sites between XbaI and NheI restriction sites (Bunker and Kingston, 1994). Embedded between the LexA operators and the NheI site is a polylinker consisting of the following restriction sites: HindIII-AscI-BamHI-AscI-HindIII. Between the NheI site and a SalI site is the zeocin resistance gene with the SV40 promoter and polyadenylation site, derived from pSV40/Zeo (Invitrogen V502-20); this is the selectable marker for the STAR screen.

Figure 2:
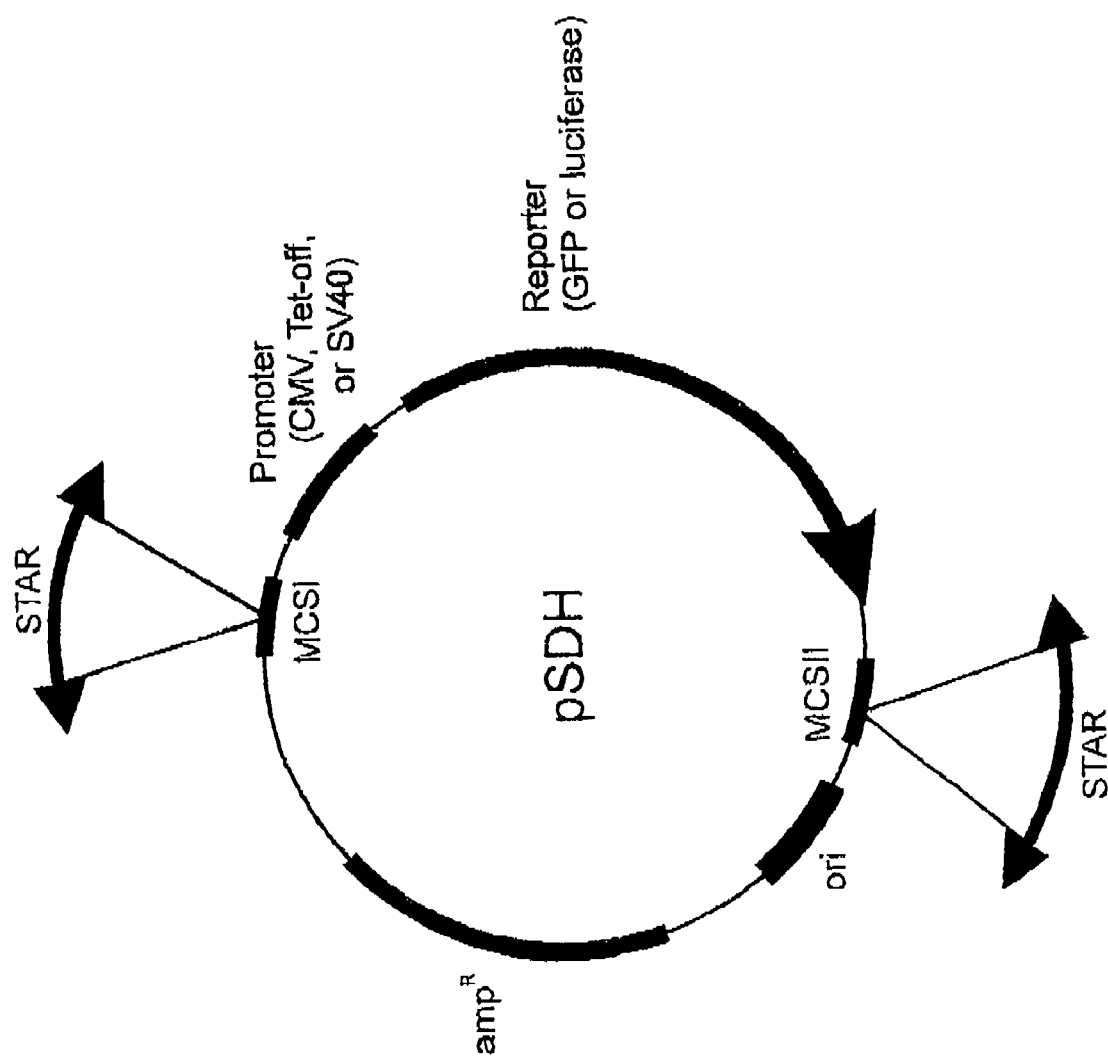
FIG. 2. The pSDH family of plasmids for testing STAR elements. Two multiple cloning sites (MCSI and MCSII) flank a reporter gene (GFP or luciferase) whose expression is driven by an upstream promoter (CMV, Tet-off, or SV40). STAR elements to be tested are inserted at MCSI and MCSII. These contain unique restriction sites (MCSI: XhoI, NotI, EcoRI, and SalI; MCSII: HindIII, EcoRV, BglII, and NheI). The plasmid replicates after integrating at random in the genome of mammalian cells.

The pSDH vector (FIG. 2) is constructed as follows: The luciferase reporter gene from pGL3-Control (Promega E1741) is amplified by PCR and inserted into SacII/BamHI-digested pUHD10-3 (Gossen and Bujard, 1992). This places luciferase under control of the Tet-Off promoter, and upstream of the SV40 polyadenylation signal. Multiple cloning sites are introduced by PCR, upstream of the Tet-Off promoter (MCSI, XhoI-NotI-EcoRI-SalI) and downstream of the polyadenylation signal (MCSII, NheI-BglII-EcoRV-HindIII).

Gene libraries are constructed by Sau3AI digestion of human genomic DNA, either purified from placenta (Clontech 6550-1) or carried in bacterial/P1 (BAC/PAC) artificial chromosomes. The BAC/PAC clones contain genomic DNA from the 1q12 cytogenetic region (clones RP1154H19 and RP3328E19) or from the HOX cluster of homeotic genes (clones RP1167F23, RP1170O19, and RP11387A1). The DNAs are size-fractionated, and the 0.5–2 kb size fraction is ligated into BamHI-digested pSelect vector, by standard techniques (Sambrook et al., 1989).

The construction of the host strains has been described (van der Vlag et al., 2000). Briefly, they are based on the U-2 OS human osteosarcoma cell line (American Type Culture Collection HTB-96). U-2 OS is stably transfected with the pTet-Off plasmid (Clontech K1620-A), encoding a protein chimera consisting of the Tet-repressor DNA binding domain and the VP16 transactivation domain. The cell line is subsequently stably transfected with fusion protein genes containing the LexA DNA binding domain, and the coding regions of either HP1 or HPC2 (two *Drosophila* Polycomb group proteins that repress gene expression when tethered to DNA). The LexA-repressor genes are under control of the Tet-Off transcriptional regulatory system (Gossen and Bujard, 1992).

Library screening and STAR element characterization. The gene libraries in pSelect are transfected into the U-2 OS/Tet-Off/LexA-repressor cell line by calcium phosphate precipitation (Graham and van der Eb, 1973; Wigler et al., 1978) as recommended by the supplier of the transfection reagent (Life Technologies). Transfected cells are cultured under hygromycin selection (25 µg/ml) and tetracycline repression (doxycycline, 10 ng/ml) for 1 week (50% confluence). Then the doxycycline concentration is reduced to 0.1 ng/ml to induce the LexA-repressor genes, and after 2 days zeocin is added to 250 µg/ml. The cells are cultured for a further 4–5 weeks, until the control cultures (transfected with empty pSelect) are killed by the zeocin.

Zeocin-resistant colonies from the library transfection are propagated, and plasmid DNA is isolated and rescued into *E. coli* by standard techniques (Sambrook et al., 1989). The candidate STAR elements in the rescued DNA are analyzed by restriction endonuclease mapping (Sambrook et al., 1989), DNA sequence analysis (Sanger et al., 1977), and for STAR activity (zeocin resistance) after re-transfection to U-2 OS/Tet-Off/LexA-repressor and lowering the doxycycline concentration.

Candidate STAR elements that have DNA sequence corresponding to known sequence in the human genome are identified by BLAST searches (Altschul et al., 1990) of the human genome database (www.ncbi.nlm.nih.gov/genome/seq/HsBlast.html20 Jun. 2001). The chromosomal locations of the elements are recorded, along with the proportion of repetitive DNA and the identity of adjacent genes.

Those candidates that show STAR activity upon re-transfection are characterized further by subcloning the STAR fragment into the pSDH plasmid and stable integration in U-2 OS chromosomal DNA. pSDH plasmids are co-transfected into U-2 OS cells with pBABE-puro (Morgenstern and Land, 1990), and selected for puromycin resistance. Per STAR element, populations of approximately 30 individual clones are isolated and cultured. The clones are periodically assayed for luciferase activity according to the manufacturer's instructions (Roche 1669893).

Results

STAR element functional characterization. The screens of human genomic DNA and of the HOX and 1q12 loci yielded 17 bona fide STAR elements (SEQ ID NOs:1–17). The criteria are that (1) the elements displayed STAR activity upon re-transfection of the pSelect-based clones into the host U-2 OS human osteosarcoma cell line (indicating that the anti-repressor activity expressed in the initial screen is plasmid-specific and not due to artifactual changes in the host cells); (2) the elements contain DNA sequence that matches sequence in the human genome sequence database (indicating that the clone does not contain contaminating DNA sequence, from e.g., bacterial or vector sources).

The STAR elements are sub-cloned into the pSDH plasmid and integrated into the host cell genome. Expression of the reporter genes is assayed in populations of stable transfectants to demonstrate the ability of the STAR elements to protect reporter genes from silencing after integration at random into the genome. This provides information (1) on the proportion of clones which display high expression, and (2) on the degree of over-expression elicited by the STAR elements.

Figure 3:
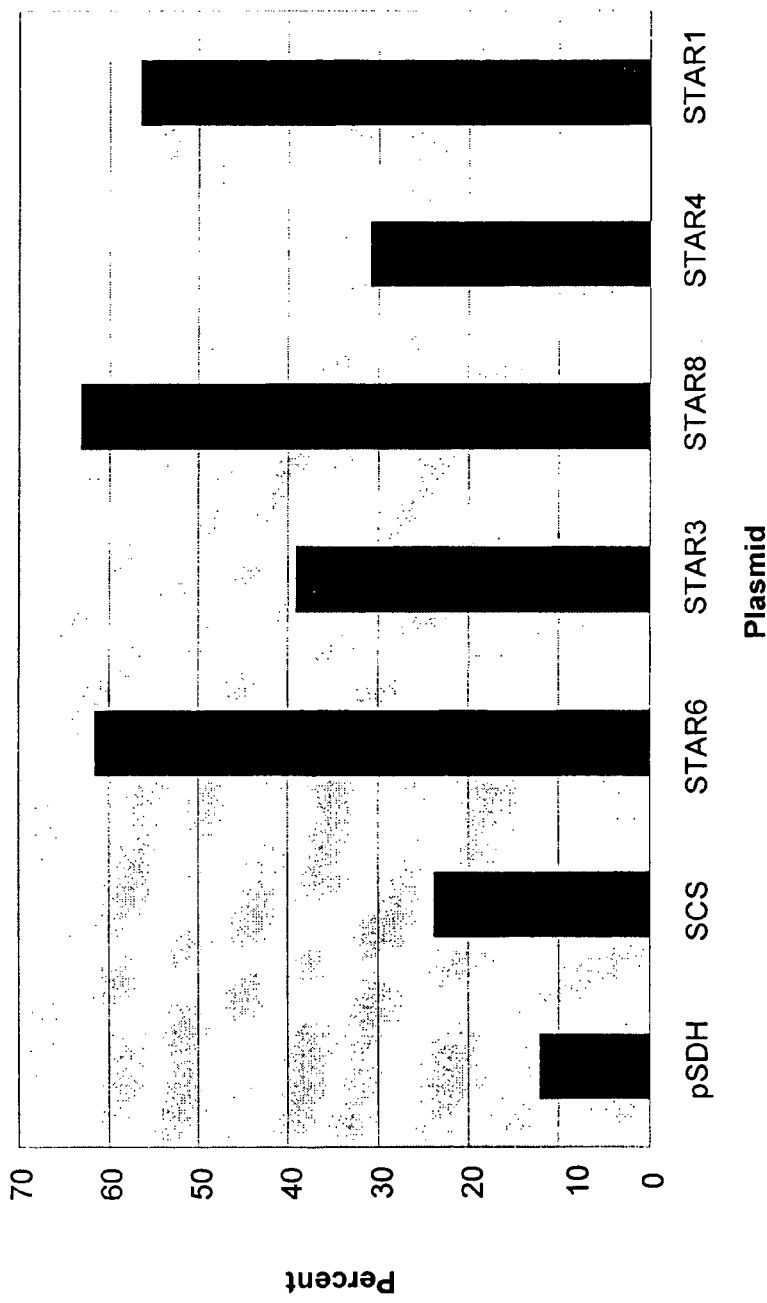
FIG. 3. Proportion of clones over-expressing luciferase. U-2 OS human osteosarcoma cells were stably transfected with pSDH plasmids (containing the luciferase reporter gene under control of the tet-off promoter), and individual transfected clones were isolated and cultivated. Luciferase expression was measured enzymatically. The average luciferase expression by clones containing the STARless pSDH ("reference level") was determined. Clones from the sets for all plasmids were scored as "over-expressing" if their luciferase activity was more than 2-fold higher than the reference level. The percentage of over-expressing clones in each plasmid set in plotted.
Figure 4:
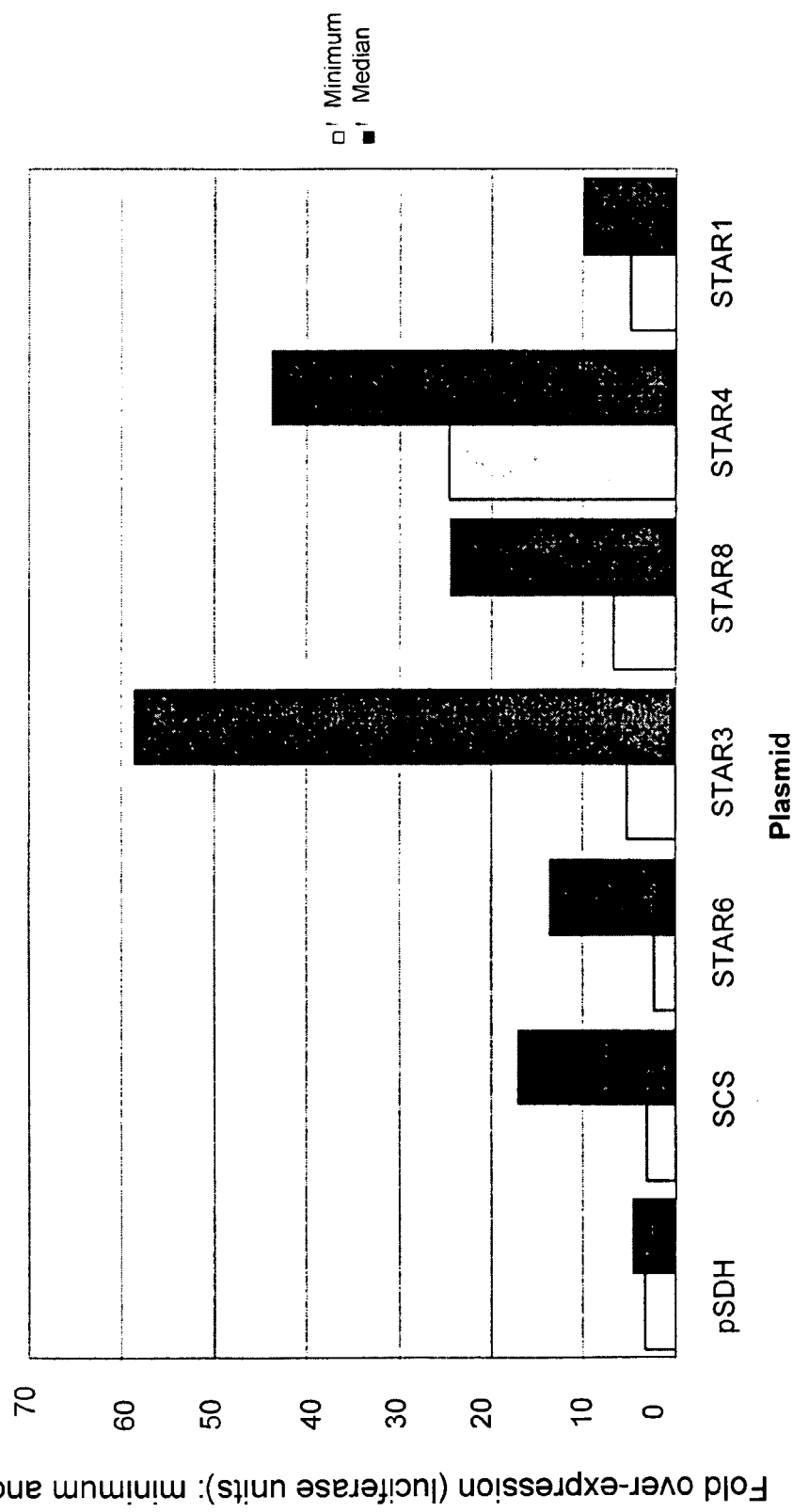
FIG. 4. Fold over-expression by over-expressing clones. The range of over-expression in STAR-containing pSDH plasmids integrated into genomic DNA was determined by dividing the luciferase activities of each clone by the reference level. For those displaying significant expression (more than 2-fold above the reference level), the actual fold increases were noted; the minimum and median values of these data are plotted for each plasmid.
Figure 5:
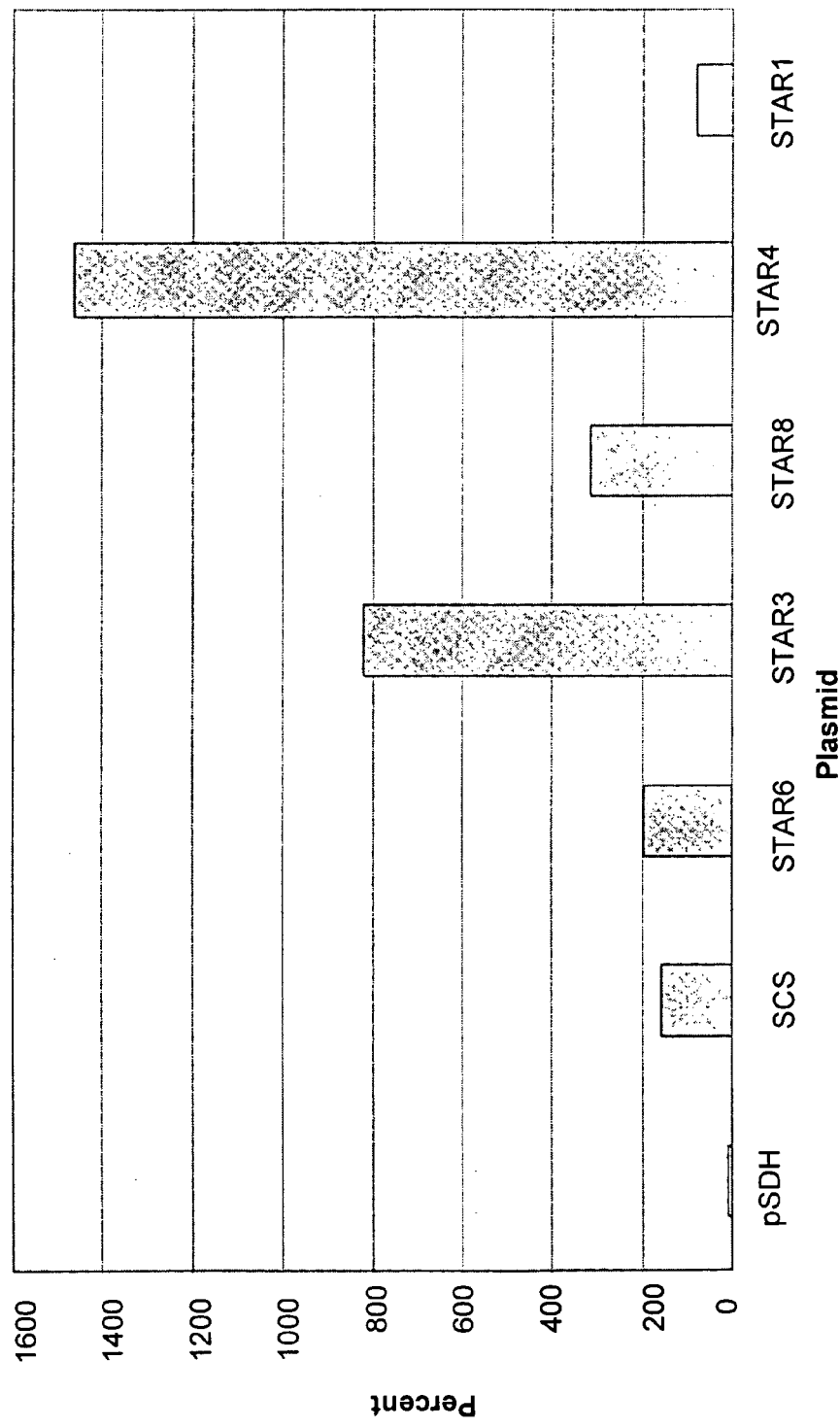
FIG. 5. Fold over-expression by over-expressing clones. The range of over-expression in STAR-containing pSDH plasmids integrated into genomic DNA was determined by dividing the luciferase activities of each clone by the reference level. For those displaying significant expression (more than 2-fold above the reference level), the actual fold increases were noted; the maximum values of these data are plotted for each plasmid.

Expression of the luciferase reporter gene by a clone is considered significant if it is two-fold above the average level for the plasmids containing no STAR elements (the reference level). For all plasmids a distribution in expression level is observed among the clones: from no expression to expression significantly above the reference level, and from few over-expressers to many over-expressers. Superior STAR activity is manifested by plasmids that result in many over-expressing clones, including some highly over-expressing clones. Results from a representative experiment are shown in Table 1, and in FIGS. 3–5 (SEQ ID NOs:6, 3, 8, 4 and 1).

The results indicate that the human STAR elements which are tested yield a much higher proportion of over-expressing clones than the unprotected reporter gene, or the reporter gene protected by the *Drosophila* SCS element (Kellum and Schedl, 1992). Furthermore, the degree of over-expression by these plasmids is much greater from the STAR-protected reporter gene than the unprotected or SCS-protected reporter.

STAR element sequence and genomic position data. Table 2 lists the chromosomal locations of each of the 17 STAR elements (SEQ ID NO:1–17), as well as the identity of nearby genes and the repetitive DNA content of the elements. The STAR elements are distributed over a number of chromosomes. They are diverse in their actual DNA sequence and repetitive DNA content, and display various degrees of association with neighboring genes.

SINC Element Screen

Materials and Methods

Figure 6:
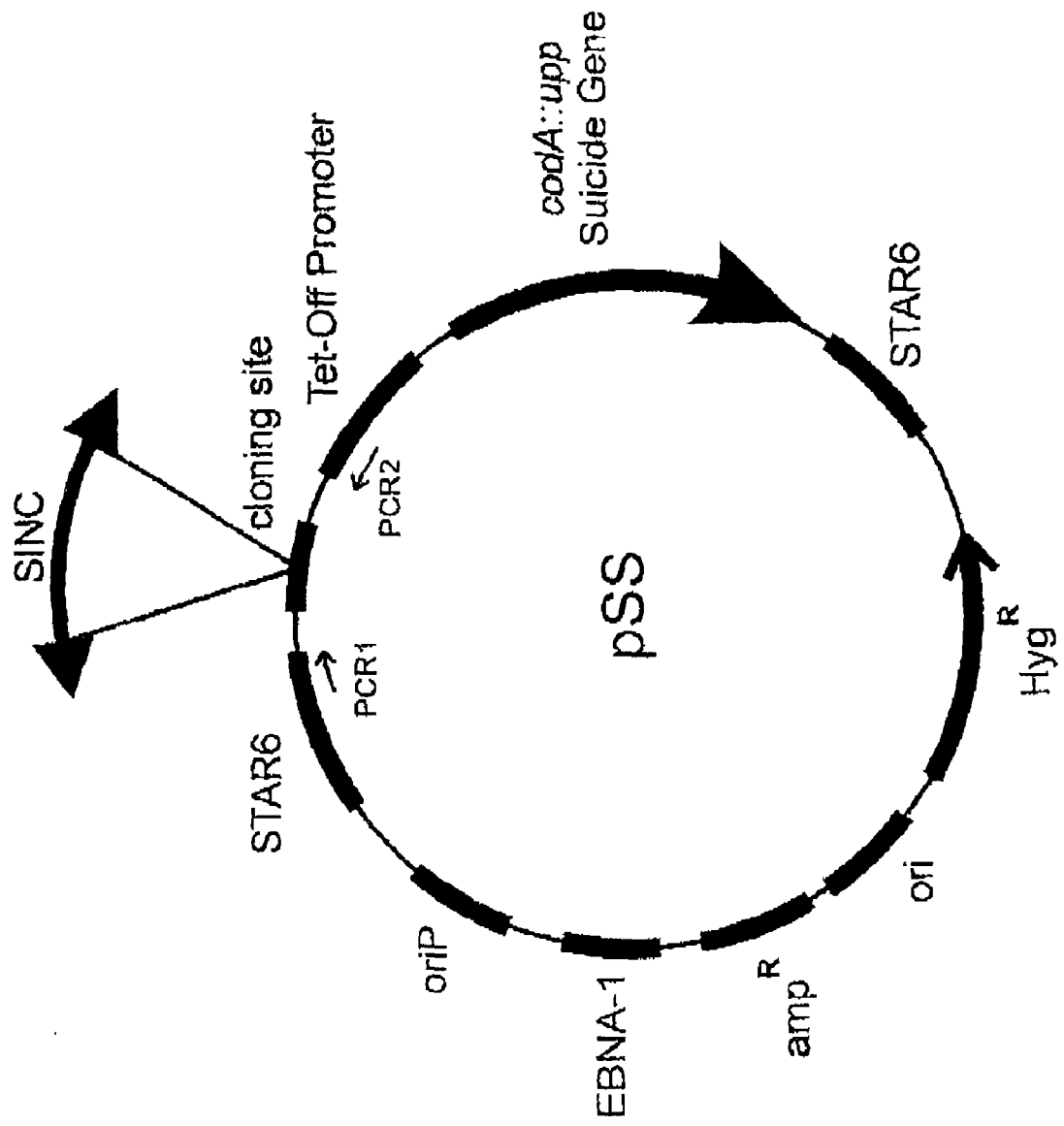
FIG. 6. The pSS (SINC-Select) plasmid for selecting and characterizing SINC elements. The codA::upp suicide gene encodes a protein that converts the pro-drug 5-fluorocytosine to the toxic drug 5-fluorouracil. Upon induction by lowered tetracycline concentration, host cells become sensitive to the pro-drug. Genomic DNA fragments inserted at the cloning site (BglII-XhoI) that have silencing activity will prevent expression of the suicide gene and allow formation of pro-drug resistant colonies. STAR elements flank the selection components to prevent spreading of silenced chromatin to the functional components of the plasmid. The plasmid replicates episomally in cultured mammalian cells due to the oriP sequence.

The plasmid for the SINC screen, pSINC-Select ("pSS", FIG. 6) is constructed as follows: the pREP4 vector (Invitrogen V004-50) is used as the plasmid backbone. It provides the Epstein Barr oriP origin of replication and EBNA-1 nuclear antigen for high-copy episomal replication in primate cell lines; the hygromycin resistance gene with the thymidine kinase promoter and polyadenylation site, for selection in mammalian cells; and the ampicillin resistance gene and colE1 origin of replication for maintenance in *Escherichia coli*. The vector contains a Tet-Off promoter, consisting of tandem Tet Responsive Elements (TREs) from plasmid pUDH10-3 (Gossen and Bujard, 1992), for regulation by the Tet-Off transcriptional regulatory system. The TREs regulate expression of the codA::upp gene encoding a fusion protein (cyotsine deaminase/uracil phosphoribosyltransferase; Invivogen porf-codaupp). This is a so-called "suicide gene"; the activity of the codA::upp enzyme converts a pro-drug 5-fluorocytosine (5-FC) to a toxic drug, 5-fluorouracil (5-FU), thereby causing apoptosis and cell death (Mullen et al., 1992; Tiraby et al., 1998; Wei and Huber, 1996). Upstream from the Tet-Off promoter is a BglII restriction site for cloning Sau3AI-digested genomic DNA for screening. The pREP4 DNA is separated from the genomic DNA and suicide gene by STAR elements in order to prevent silencing of essential plasmid elements in the pREP4 component by cloned SINC elements.

Genomic DNA from a library of BAC clones comprising human chromosome 22 (Invitrogen/Research Genetics 96010-22) is partially digested with Sau3AI and ligated into BglII-digested pSS (Sambrook et al., 1989). The library of recombinant plasmids is transfected into the U-2 OS/Tet-Off cell line by calcium phosphate precipitation (Graham and van der Eb, 1973; Wigler et al., 1978) as recommended by the supplier of the transfection reagent (Life Technologies). Transfected cells are cultured under hygromycin selection (25 μg/ml) and tetracycline repression (doxycycline, 10 ng/ml) for 3 weeks. Then 5-FC is added to a concentration of 1 μg/ml and the cells are cultured for a further 3 weeks to select for SINC elements.

Candidate SINC-containing colonies are harvested and used in a polymerase chain reaction with primers PCR1 and PCR2 (FIG. 6); the PCR products are digested with HindIII and XhoI restriction endonucleases and cloned into pBluescript II SK(+) (Stratagene 212207) by conventional techniques (Sambrook et al., 1989). The DNA sequences of the candidate SINC elements are determined (Sanger et al., 1977), and corresponding sequences in the human genome are identified by BLAST searches (Altschul et al., 1990) of the human genome database (www.ncbi.nlm.nih.gov/genome/seq/HsBlast.html 20 Jun. 2001). The chromosomal locations of the elements are recorded, along with the proportion of repetitive DNA and the identity of adjacent genes.

Results

At the end of the selection period no colonies are evident in the control cultures (empty pSS), and a number of colonies are evident in the cultures containing pSS with genomic DNA. These surviving clones contain candidate SINC elements. The elements are recovered by PCR and subcloned into a standard cloning vector, pBluescript. The DNA sequences of the elements are determined, and compared with the human genome sequence (Table 3 (SEQ ID NOs:135–140)). In all cases, the sequenced elements are found on chromosome 22, as expected.

Example 2

Expression Characteristics of the Transgene Due to the STAR, the SINC, or the Combined STAR/SINC Background: site-specific recombination is used to precisely remove heterologous DNAs from their chromosomal locations. This is routinely carried out by one of two systems: the cre recombinase and loxP target of bacteriophage P1 (Feng et al., 1999), or the FLP recombinase and FRT (FLP recombinase target) of yeast (Wigley et al., 1994). In these systems, a DNA region (usually containing a reporter gene and/or a selectable marker) is flanked in the chromosome by the loxP or FRT target. The activity of the recombinase then catalyzes the precise excision of the DNA region from the chromosome. The recombinase resolves its two recognition sequences to a single site, deleting the sequence between them. Thus, a span of DNA must be flanked by target sites to be subsequently deleted in vivo upon introduction or activation of recombinase (Schwenk et al., 1995; Dymecki, 1996). The Cre and Flp recombinases catalyze recombination between two 13-base-pair inverted repeats, separated by a spacer with a minimum of 6 (loxP) or 8 (FRT) base pairs (Senecoff et al., 1985). The loxP sequence is ATAACTTCGTATA (SEQ ID NO:120) and the FRT sequence is GAAGTTCCTATAC (SEQ ID NO:121).

Protocol: Using conventional DNA cloning (Sambrook et al., 1989), a reporter gene (encoding a reporter protein, for example green fluorescent protein (GFP) (Bierhuizen et al., 1997) or luciferase (Himes and Shannon, 2000) is constructed that is flanked in a plasmid by a pair of STAR elements, by a pair of SINC elements, or by a pair of STAR/SINC combination elements. In each case, the elements are themselves flanked by recombinase target sites. One element is flanked by a pair of loxP sites, and the other is flanked by a pair of FRT sites (FIG. 1). Upon transfection the plasmid integrates into the host chromosome in a small percentage of cells, and the integrants are selected by antibiotic resistance. Similar constructs are made for each of the three test elements (STAR, SINC, STAR/SINC).

Using conventional techniques, ("SuperFect Transfection Reagent Handbook," Qiagen, November, 1997) these plasmids are transfected into the U-2 OS human osteosarcoma cell line, and selected for hygromycin resistance. Hygromycin-resistant isolates have the plasmid stably integrated in the genome of the cell line. Individual isolates are propagated in cell culture medium, and the expression of the transgenic reporter gene is assayed, for example by flow cytometry (Stull et al., 2000).

Then, using conventional techniques (transfection, or hormone stimulation), the stable isolates from above are treated so as to introduce or activate recombinase activity. This is done sequentially, such that for example the cre recombinase activity catalyzes excision of STAR1 (SEQ ID NO:1), and subsequently FLP recombinase activity catalyzes excision of STAR2 (SEQ ID NO:2). The level of expression of the reporter gene in these cells is assayed and the value compared with the reference value of the parental, STAR-containing isolate.

Example 3

Sequence Analysis of Stars; Determination of Minimal Essential Sequence for Element Function; Sequence Conservation Among Elements; and Properties of Tandem and Multiple Elements Background: DNA fragments containing STAR or SINC elements are isolated by genetic selection using the pSelect (FIG. 1) or pSS (FIG. 6) plasmids, respectively. This section describes the approach to characterize the DNA sequences within those fragments that have STAR or SINC activity.

Protocols:

DNA sequence: Oligonucleotides are designed based on the sequence of the pSelect and pSS selection plasmids for sequencing the DNA fragments. The fragments are sequenced using the dideoxy chain termination technique (Sanger et al., 1977). DNA sequences are then localized to chromosome position using the public human genome sequence database (www.ncbi.nlm.nih.gov:80/cgi-bin/Entrez/hum_srch?chr=hum_chr.inf&query). Genes and gene density in the vicinity of the fragment sequence are recorded from the genome sequence annotation. Transcriptional activity of those genes is determined from public databases of DNA microarray (arrays.rockefeller.edu/xenopus/links.html) and SAGE (Serial Analysis of Gene Expression; bioinfo.amc.uva.nl/HTM-bin/index.cgi) data.

Once positional information on STAR and SINC sequences is compiled, the data are analysed in terms of underlying consensus sequences. Consensus sequences or trends (understood by this are local areas rich in particular nucleotide combinations, e.g., rich in C and G bases) are detected using similarity search algorithms such as clustalw (Higgins et al., 1996) and blosum similarity scoring (Altschul and Gish, 1996). Any underlying consensuses or trends found are then used to identify other potential STARs on a genome scale by performing BLAST searches (Altschul et al., 1990).

Previous research has identified transcriptional regulatory proteins that bind to known insulators and boundary elements (Gaszner et al., 1999; Gerasimova and Corces, 1998). In the described examples, the protein binding sites coincide with DNase I hypersensitive sites which are essential for insulator or boundary function. The hypothesis that STAR elements are also bound by known regulatory proteins is examined by searching the TRANSFAC database of transcription factors (transfac.gbf.de/TRANSFAC/) for sequence motifs that occur in the STAR elements. Sequence motifs that are common among the members of the STAR or SINC collections are indicators that the corresponding transcription factor binds to that element.

Minimal essential sequence: Using this sequence knowledge STAR (or SINC) elements are truncated and tested for functionality. This is done using the polymerase chain reaction (PCR) to clone sub-fragments of the STAR- or SINC-containing fragments into pSelect or pSS by standard techniques (Sambrook et al., 1989). The plasmids containing the sub-fragments are transfected into U-2 OS cells and tested for functionality by assaying for antibiotic resistance (STAR elements) or pro-drug resistance (SINC elements).

Directionality: The STAR and SINC elements are tested for their directionality using the pSelect and pSS plasmids, respectively. For example, the direction of STAR elements isolated by the pSelect screen is referred to as 5'3' orientation. The orientation of the element is reversed by conventional recombinant DNA techniques (Sambrook et al., 1989). The resulting plasmids are transfected into the U-2 OS cell line and expression of the reporter gene is assayed (Bierhuizen et al., 1997; Himes and Shannon, 2000). The level of expression from the plasmid with the reverse-orientation element is compared to that with the 5'3' orientation. If the reverse-orientation plasmid has similar expression levels, then the STAR element does not display directionality.

Combinations and multiples of elements: To determine whether STAR elements are able to function in mixed pairs, different elements are combined and tested. The analysis is performed in the pSDH plasmid by inserting one STAR element in MCSI and a different STAR in MCSII by recombinant DNA techniques (Sambrook et al., 1989). The resulting plasmids are transfected, and the expression of the reporter gene is assayed (Bierhuizen et al., 1997; Himes and Shannon, 2000); the results are compared with the expression from plasmids containing the same element at MCSI and MCSII; if the expression is similar for the two types of plasmids, then it is concluded that different STAR elements do not interfere with each other.

The strength of single STAR or SINC elements is compared with tandem repeats of elements. This is done by concatamerization of the STAR or SINC elements of interest with DNA ligase and insertion of the ligation product into the pSDH or pSS plasmids by recombinant DNA techniques (Sambrook et al., 1989). The resulting plasmids are transfected into U-2 OS cells, and the expression of the reporter gene is assayed (Bierhuizen et al., 1997; Himes and Shannon, 2000); the results are compared with the expression from plasmids containing single STAR or SINC elements.

Example 4

Determination of the Distance Over which a STAR, a SINC, or a Combination Thereof Functions Background: STAR elements are used to optimize expression of single and multiple transgenes. To determine if a single pair of STAR elements can protect large or multiple transgenes from silencing it is necessary to determine the range over which STAR elements act. Similar information is determined for SINC elements and STAR/SINC combinations.

Protocol: STAR and SINC elements are tested for their functionality over distance using derivative plasmids based on pSelect or pSS respectively, as follows. A library of random DNA fragments from 500 bp to 10 kb is assembled by standard DNA cloning techniques (Sambrook et al., 1989). Fragments are selected from this library that do not possess STAR or SINC activity, by testing in the pSelect and pSS plasmids as described above. For STAR elements and STAR/SINC combinations, these fragments are inserted between the cloning site and the promoter of the reporter gene in the appropriate pSelect plasmid (FIG. 1). This set of plasmids is transfected into the U-2 OS cell line, and expression measured as described above. The strength of reporter gene expression is correlated with the length of the random DNA fragment separating the STAR element from the promoter. SINC elements are assessed in an analogous fashion: random DNA fragments are inserted between the SINC element and the promoter of the appropriate pSS plasmid, and the degree of repression of the reporter gene is correlated with the length of the random DNA fragment.

Example 5

(a) Use of a Naturally Occurring SINC Element in the Genetic Selection for STAR Elements Background: The current screens for STAR elements use chimeric lexA-PcG proteins to provide repression of the selectable marker in the selection plasmid. By repeating the selection using naturally occurring SINC elements, STAR elements are identified that are specific to the repressive activity due to these naturally occurring SINC elements.

The SINC element screen is based on the ability of genetic selection to identify randomly generated fragments of genomic DNA that are able to silence a "tet-off" promoter and block the expression of the codA::upp suicide gene. The SINC elements recovered from this selection represent a random sampling of genomic silencing elements, and different classes of elements are recovered. For this protocol, these diverse SINC elements are used to recover different classes of STAR elements than those recovered in the aforementioned lexA-PcG based selections.

Protocol: SINC elements from the current selection are characterized and sorted into classes on the basis of functional and DNA sequence features (functional features include strength of repression; sequence features include identifiable conserved motifs; see example 3). Representative elements from each class are used to replace the lexA binding sites in the pSelect plasmid via standard DNA cloning techniques (Sambrook et al., 1989). A gene bank is made with each of these new plasmids, and used to identify new, SINC-specific STAR elements as described (van der Vlag et al., 2000). This is done with whole genomic DNA, and with DNA from the BAC clone that also contains the SINC element being used.

Example 5

(b) Determination of the Maximal Length of STAR and SINC Elements

Background: STAR elements are cloned as fragments of DNA recovered using the pSelect plasmid, which is done with genomic DNA fragments less than 2 kb. However, these might be portions of a more extended STAR element. Extended STAR activity is examined by the following experiments.

Protocol: STAR elements cloned in pSelect are mapped to the human genome sequence. In order to determine if they are portions of a more extended STAR element, regions of 4 kb that encompass the clones are amplified by PCR and cloned into the pSelect and/or pSDH plasmid by standard recombinant DNA techniques (Sambrook et al., 1989). The resulting plasmids are transfected into U-2 OS cells and assayed for reporter gene expression as described above; plasmids containing the original 2 kb STAR element are included as a control. Three possible results can be expected: (1) similar expression by the control and extended STAR isolates, demonstrating that the STAR element is confined to the original 2 kb fragment; (2) lower expression by the extended STAR isolates, suggesting that the STAR element is contained within the 2 kb fragment and does not act effectively over a distance or that the extended fragment contains a SINC element; (3) higher expression by the extended STAR isolates, suggesting that the extended region contains a more complete STAR element. In the case of result (3), the exercise is reiterated with a larger PCR fragment of 6 kb.

A STAR element may also be a composite of sites to which various proteins bind. Therefore large DNA fragments with STAR activity could be divisible into smaller fragments with STAR activity (see example 3). Elements that are greater than 2 kb are recognized as STAR elements if they still display STAR activity after truncation to less than 2 kb (including by internal deletion).

Example 6

Methylation and Histone Acetylation States of STAR Elements, SINC Elements, or Combinations Thereof and of the Adjacent Transgenes Background: The regulatory properties of STAR and SINC elements are associated with the local chromatin structure, which is determined by the DNA itself and by DNA-associated proteins. Changes in chromatin structure that are associated with changes in gene expression are often produced by secondary modifications of the macromolecules, especially methylation of DNA or acetylation of histone proteins. Identifying the secondary modifications occurring at STAR and SINC elements and at adjacent transgenes provides hallmarks for these elements.

Protocol: DNA methylation: STAR or SINC elements or combinations thereof are cloned into the pSelect plasmid by standard techniques (Sambrook et al., 1989). U-2 OS cells are stably transfected with these plasmids, and with pSelect lacking a STAR or SINC element as a control to determine basal DNA methylation at the reporter gene. Cells are harvested and the chromatin purified by standard procedures (Thomas, 1998). The DNA is digested with the HpaII and MspI restriction endonucleases in separate reactions (Sambrook et al., 1989). Both of these restriction enzymes are able to cut the non-methylated sequence CCGG. When the external C is methylated, both MspI and HpaII cannot cleave. However, unlike HpaII, MspI can cleave the sequence when the internal C is methylated. The DNA is subjected to Southern blotting and the blot is analyzed by indirect end-labeling (Pazin and Kadonaga, 1998). As a control, the corresponding pSelect plasmid as naked, unmethylated DNA, is also cut with the described enzymes and subjected to Southern blotting. Comparison of the different sizes of the DNA fragments reveals whether the DNA is methylated in vivo or not.

Histone acetylation: The same transfected cell lines used for DNA methylation analysis are used for these experiments. The method described below yields a high resolution map of the histone acetylation pattern on the STAR and SINC elements and the reporter gene (Litt et al., 2001). Micrococcal nuclease digests of nuclei are fractionated on sucrose gradients, and purified nucleosome monomers and dimers are enriched for acetylated histones by immunoprecipitation with anti-acetylhistone antibodies. The nucleosome fraction and immunoprecipitates are subjected to analysis, for example by real-time PCR (Jung et al., 2000) using primers and a Taqman probe that anneal to the reporter gene or to the STAR or SINC element to yield 0.2 kb products, with a moving window of 0.1 kb. The rate of increase of the Taqman probe fluorescent signal during the PCR (which is proportional to the abundance of the template DNA in the sample) is then measured. The ratio of the abundance of the template DNA in the nucleosome fraction and the immunoprecipitates provides a fine-map of the pattern of histone acetylation for each 0.1 kb on the reporter gene and STAR or SINC element (or on the reporter gene in the absence of an element).

Example 7

In Vivo Nucleosome Positioning and DNAse I Hypersensitive Sites

Background: Chromatin is comprised of DNA, histones, and non-histone proteins. The histones form a core particle that is wrapped by ~150 bp of DNA to make a nucleosome. Nucleosomes are separated by 50–75 bp of linker DNA. Stably positioned nucleosomes on chromosomal DNA repress gene expression, and factors that exclude nucleosomes or otherwise remodel chromatin can overcome this repression. The positioning of nucleosomes in a chromosomal region is analyzed by micrococcal nuclease (MNase) assay; MNase cuts chromatin preferentially in the linker DNA. Similarly, some areas of DNA are constitutively exposed to non-histone proteins, and these are frequently regulatory regions, i.e. sites where cis-acting regulatory factors bind. Experimentally, these site are hypersensitive to digestion by the enzyme DNase I.

Protocol: To determine the position of nucleosomes on the reporter gene and on either the STAR or SINC elements, MNase is used (Saluz and Jost, 1993). Nuclei are purified from cultured U-2 OS cells and digested with MNase as described above (histone acetylation). To search for DNase I hypersensitive sites in the STAR and SINC elements or the reporter gene, purified nuclei are treated with DNase I at an appropriate concentration (e.g., 100 µg/ml genomic DNA and 20–100 U/ml DNase I), as described (Wallrath et al., 1998). Naked DNA is digested with DNase I as a control. For both techniques, the reporter gene and STAR or SINC elements are fine-mapped using primer extension or indirect end-labelling and Southern blotting, as described (Tanaka et al., 1996; van der Vlag et al., 2000). The MNase assay reveals a ladder of discrete bands on an autoradiogram corresponding to the positions of nucleosomes on the STAR or SINC elements or the reporter gene. DNase I hypersensitive sites are manifested as discrete bands in the resulting autoradiogram that are absent or less prominent in the naked DNA control.

Example 8

Cell-Type, Tissue Dependence, and Promoter Dependence of STAR and SINC Elements

Background: It has been reported that some insulators or boundary elements may display tissue specificity (Takada et al., 2000). STAR elements have many features in common with insulators and boundary elements. Both promiscuous and tissue-specific STAR and SINC elements have biotechnological value in transgenic applications. The assay described below is performed to assess cell-type dependence. Cell and tissue specificity of the elements are examined further by examining the expression of genes in the vicinity of the elements in the human genome, using public databases of DNA microarray (arrays.rockefeller.edu/xenopus/links.html) and SAGE (Serial Analysis of Gene Expression; bioinfo.amc.uva.nl/HTM-bin/index.cgi) data.

Protocol: STAR elements are tested in the pSDH plasmid, and SINC elements in the pSS plasmid. Three cell lines are transfected using standard protocols: the human U-2 OS osteosarcoma cell line (Heldin et al., 1986), the Vero cell line from African green monkey kidney (Simizu et al., 1967), and the CHO cell line from Chinese hamster ovary (Kao and Puck, 1968). Elements able to function in all three cell types are categorized as promiscuous. Those only displaying activity in one or two of the cell-lines are categorized as restricted in their cell-type functionality.

Promoter specificity: STAR and SINC elements are currently selected and tested in the context of function with two promoters, the entire cytomegalovirus (CMV) promoter or the Tetracycline Response Element and minimal CMV promoter (in combination with the tTA transcriptional activator). To assess promoter specificity, STAR and SINC function are tested with other commonly used viral promoters, namely the simian virus type 40 (SV40) early and late promoters, the adenoviral E1A and major late promoters, and the Rous sarcoma virus (RSV) long terminal repeat (Doll et al., 1996; Smith et al., 2000; Weaver and Kadan, 2000; Xu et al., 1995). Each of these promoters are cloned separately into the pSelect and pSS plasmids by standard techniques (Sambrook et al., 1989) along with STAR or SINC elements, respectively. The resulting plasmids are transfected into the U-2 OS cell line and assayed for reporter gene expression, as described above. The ability of SINC elements to silence these promoters, or STAR elements to protect against silencing, is determined by comparison with plasmids lacking STAR or SINC elements.

Example 9

Methods for Improvement of STAR and SINC Elements

Background: Improved STAR and SINC elements are developed. Improvements yield increased strength of anti-repressive or repressive activity, and elements with inducible and tissue-specific activity. These improvements are made by a combination of techniques.

Protocols

Forced evolution: Error prone PCR (Cherry et al., 1999; Henke and Bornscheuer, 1999) is used to introduce an average of one to two point mutations per element. The mutagenized elements are screened using pSelect (or pSS) plasmids containing reporter-selectable marker fusion proteins by for example fluorescence activated cell sorting and antibiotic resistance (Bennett et al., 1998). Subsequent rounds of error prone PCR and selection are carried out to derive elements with further improvements in activity.

Tandem and heterologous combinations: As described above, tandem and heterologous combinations of elements are tested for activity in comparison with the single elements (Example 3).

The relative dominance of STAR and SINC elements is tested on a case by case basis. It is used to test the strength of an element; for example, if a new STAR element is dominant to a known, strong SINC element, then the STAR is classified as very strong. The possibility that the dominance relationship between a STAR and a SINC is cell type-, tissue-, or promoter-specific is also considered (example 8). The dominance test utilizes the pSelect plasmid, with individual SINC elements placed upstream of individual STAR elements by standard recombinant DNA techniques (Sambrook et al., 1989). The plasmids are transfected to U-2 OS cells and reporter gene expression is assayed. SINC dominance is manifested by lower expression than the plasmid with only a STAR element, while STAR dominance is manifested by higher expression than the plasmid with only a SINC element.

Introduction of binding sites for other DNA-binding proteins to STAR and SINC elements to add novel characteristics (e.g., inducibility, tissue specificity)

Background: Regulatable STAR and SINC elements are created by combining them with binding sites for signal-dependent DNA binding proteins. In one example this would involve juxtaposition of a STAR or SINC or STAR/SINC combination and a glucocorticoid response element (GRE). In the absence of glucocorticoid stimulation the STAR or SINC element would function as described. Upon stimulation, the naturally occurring glucocorticoid receptor binds to the GRE and interferes with STAR or SINC function.

Protocol: Using conventional DNA cloning (Sambrook et al., 1989), a GRE is introduced into the pSelect or pSS vector adjacent to STAR or SINC elements, respectively. The plasmid is transfected into U-2 OS cells as described above. Cells are divided into two cultures; one is treated with glucocorticoid (10 μM). Expression of the reporter gene is measured and compared between the two cultures. Differences in expression demonstrate the ability to regulate STAR and SINC function by action of a signal-dependent DNA-binding protein.

Promiscuous STAR and SINC elements: Testing or enhancing these characteristics involves cultivation in different cell lines, and long term cultivation without antibiotic selection (Examples 8 and 10).

Example 10

STAR and SINC Elements Obviate the Need for Continuous Selection for Maintenance of the Transgene In transgenesis, reliance on selection markers has two drawbacks: the selection agent is usually expensive and carries a metabolic cost to the cells, and there are regulatory and ethical objections to including selectable markers in transgenic applications, especially if the transgene itself is in the product (e.g., crop plants, gene therapy vectors). STAR and SINC elements reduce or eliminate the need to maintain selection after establishing the transgenic isolate. Consequently, the resistance gene can be removed from the transgenic genome by site-specific recombination with diminished loss of transgene expression.

Protocol: Stably transfected U-2 OS cell lines containing chromosomally-integrated STAR elements flanking reporter genes are produced by co-transfection of the pSDH plasmid with a trans-acting antibiotic resistance plasmid as described above. The experiment involves testing the stability of the reporter gene expression level in these cell lines during prolonged (3–6 month) cultivation in the absence of selection. This is tested with STAR elements flanking the luciferase or GFP reporter genes in pSDH plasmids.

The antibiotic resistance gene is removed by constructing an expression plasmid (based on pSDH) in which the antibiotic selection marker is flanked by recombinase target sites. The selectable marker is subsequently excised by recombinase activity, as described above (Example 2).

Example 11

Predictability and Yield are Improved by Application of STAR Elements in Expression Systems STAR elements function to block the effect of transcriptional repression influences on transgene expression units. These repression influences can be due to heterochromatin ("position effects", (Boivin & Dura, 1998)) or to adjacent copies of the transgene ("repeat-induced gene silencing", (Garrick et al., 1998)). Two of the benefits of STAR elements for heterologous protein production are increased predictability of finding high-expressing primary recombinant host cells, and increased yield during production cycles. These benefits are illustrated in this example.

Materials and Methods

Figure 7:
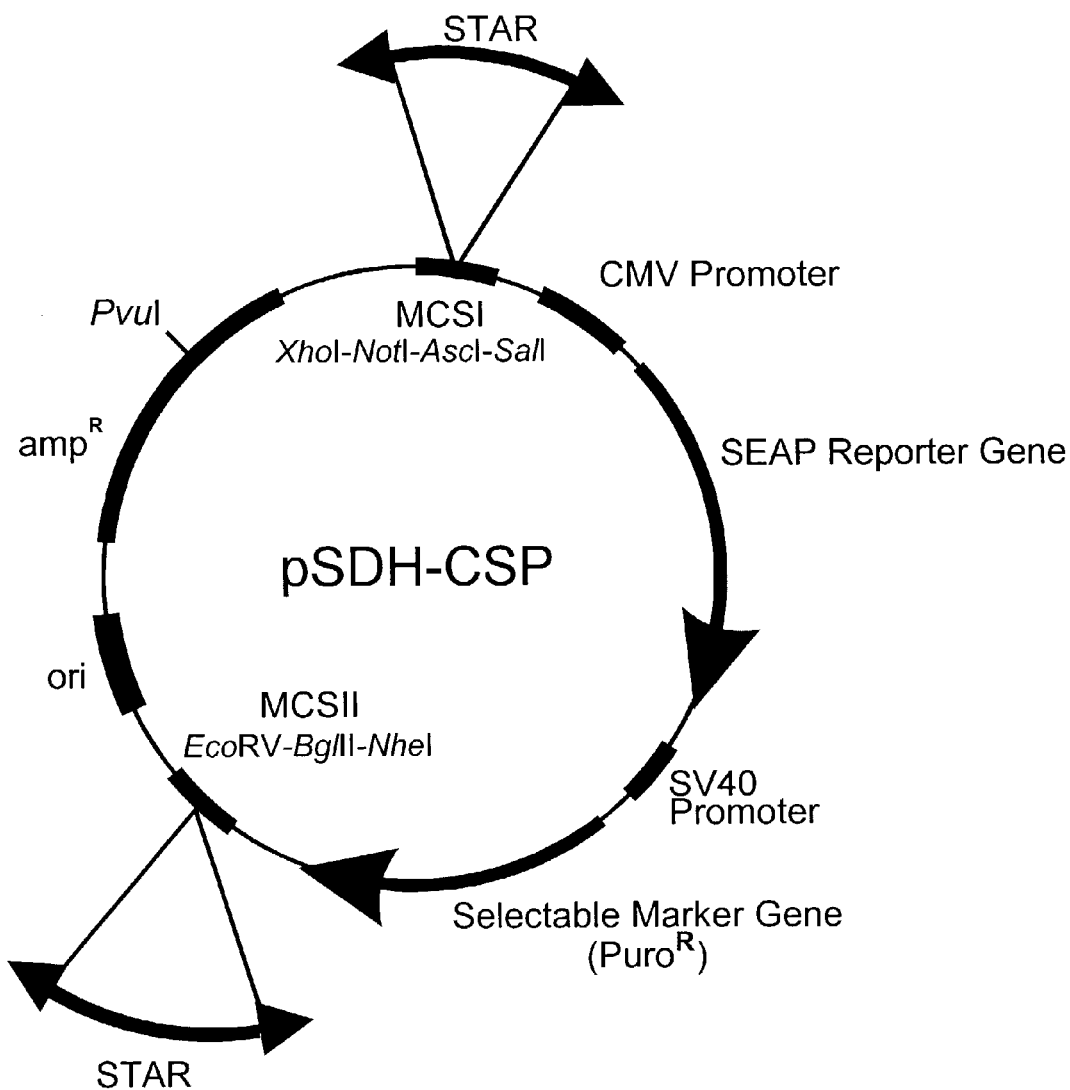
FIG. 7. The pSDH-CSP plasmid used for testing STAR activity. The Secreted Alkaline Phosphatase (SEAP) reporter gene is under control of the CMV promoter, and the puromycin resistance selectable marker (puro) is under control of the SV40 promoter. Flanking these two genes are multiple cloning sites into which STAR elements can be cloned. The plasmid also has an origin of replication (ori) and ampicillin resistance gene (ampR) for propagation in *Escherichia coli*

Construction of the pSDH vectors and STAR-containing derivatives: The pSDH-Tet vector was constructed by polymerase chain reaction amplification (PCR) of the luciferase open reading frame from plasmid pREP4-HSF-Luc (van der Vlag et al., 2000) using primers C67 (SEQ ID NO:143) and C68 (SEQ ID NO:144)(all PCR primers and mutagenic oligonucleotides are listed in Table 5 (SEQ ID NOs: 141–183)), and insertion of the SacII/BamHI fragment into SacII/BamHI-digested pUHD10-3 (Gossen & Bujard, 1992). The luciferase expression unit was re-amplified with primers C65 (SEQ ID NO:141) and C66 (SEQ ID NO:142), and re-inserted into pUHD10-3 in order to flank it with two multiple cloning sites (MCSI and MCSII). An AscI site was then introduced into MCSI by digestion with EcoRI and insertion of a linker (comprised of annealed oligonucleotides D93 (SEQ ID NO:155) and D94 (SEQ ID NO:156)). The CMV promoter was amplified from plasmid pCMV-Bsd (Invitrogen K510-01) with primers D90 (SEQ ID NO:153) and D91 (SEQ ID NO:154), and used to replace the Tet-Off promoter in pSDH-Tet by SalI/SacII digestion and ligation to create vector pSDH-CMV. The luciferase open reading frame in this vector was replaced by SEAP (Secreted Alkaline Phosphatase) as follows: vector pSDH-CMV was digested with SacII and BamHI and made blunt; the SEAP open reading frame was isolated from pSEAP-basic (Clontech 6037-1) by EcoRI/SalI digestion, made blunt and ligated into pSDH-CMV to create vector pSDH-CS. The puromycin resistance gene under control of the SV40 promoter was isolated from plasmid pBabe-Puro (Morgenstern & Land, 1990) by PCR, using primers C81 (SEQ ID NO:145) and C82 (SEQ ID NO:146). This was ligated into vector pGL3-control (BamHI site removed) (Promega E1741) digested with NcoI/XbaI, to create pGL3-puro. pGL3-puro was digested with BglII/SalI to isolate the SV40-puro resistance gene, which was made blunt and ligated into NheI digested, blunt-ended pSDH-CS. The resulting vector, pSDH-CSP, is shown in FIG. 7. All cloning steps were carried out following the instructions provided by the manufacturers of the reagents, according to methods known in the art (Sambrook et al., 1989).

STAR elements were inserted into MCSI and MCSII in two steps, by digestion of the STAR element and the pSDH-CSP vector with an appropriate restriction enzyme, followed by ligation. The orientation of STAR elements in recombinant pSDH vectors was determined by restriction mapping. The identity and orientation of the inserts were verified by DNA sequence analysis. Sequencing was performed by the dideoxy method (Sanger et al., 1977) using a Beckman CEQ2000 automated DNA sequencer, according to the manufacturer's instructions. Briefly, DNA was purified from *E. coli* using QIAprep Spin Miniprep and Plasmid Midi Kits (QIAGEN 27106 and 12145, respectively). Cycle sequencing was carried out using custom oligonucleotides C85 (SEQ ID NO:147), E25 (SEQ ID NO:170), and E42 (SEQ ID NO:171)(Table 5), in the presence of dye terminators (CEQ Dye Terminator Cycle Sequencing Kit, Beckman 608000).

Transfection and culture of CHO cells with pSDH plasmids: The Chinese Hamster Ovary cell line CHO-K1 (ATCC CCL-61) was cultured in HAMS-F12 medium +10% Fetal Calf Serum containing 2 mM glutamine, 100 U/ml penicillin, and 100 micrograms/ml streptomycin at 37 C/5% CO2. Cells were transfected with the pSDH-CSP vector, and its derivatives containing STAR6 or STAR49 in MCSI and MCSII, using SuperFect (QIAGEN) as described by the manufacturer. Briefly, cells were seeded to culture vessels and grown overnight to 70–90% confluence. SuperFect reagent was combined with plasmid DNA (linearized in this example by digestion with PvuI) at a ratio of 6 microliters per microgram (e.g., for a 10 cm Petri dish, 20 micrograms DNA and 120 microliters SuperFect) and added to the cells. After overnight incubation the transfection mixture was replaced with fresh medium, and the transfected cells were incubated further. After overnight cultivation, 5 micrograms/ml puromycin was added. Puromycin selection was complete in 2 weeks, after which time individual puromycin resistant CHO/pSDH-CSP clones were isolated at random and cultured further.

Secreted Alkaline Phosphatase (SEAP) assay: SEAP activity (Berger et al., 1988, Henthorn et al., 1988, Kain, 1997, Yang et al., 1997) in the culture medium of CHO/pSDH-CSP clones was determined as described by the manufacturer (Clontech Great EscAPe kit #K2041). Briefly, an aliquot of medium was heat inactivated at 65 C, then combined with assay buffer and CSPD chemiluminescent substrate and incubated at room temperature for 10 minutes. The rate of substrate conversion was then determined in a luminometer (Turner 20/20TD). Cell density was determined by counting trypsinized cells in a Coulter ACT10 cell counter.

Transfection and culture of U-2 OS cells with pSDH plasmids: The human osteosarcoma U-2 OS cell line (ATCC #HTB-96) was cultured in Dulbecco's Modified Eagle Medium +10% Fetal Calf Serum containing glutamine, penicillin, and streptomycin (supra) at 37 C/5% CO2. Cells were co-transfected with the pSDH-CMV vector, and its derivatives containing STAR6 (SEQ ID NO:6) or STAR8 (SEQ ID NO:8) in MCSI and MCSII, (along with plasmid pBabe-Puro) using SuperFect (supra). Puromycin selection was complete in 2 weeks, after which time individual puromycin resistant U-2 OS/pSDH-CMV clones were isolated at random and cultured further.

Luciferase assay: Luciferase activity (Himes & Shannon, 2000) was assayed in resuspended cells according to the instructions of the assay kit manufacturer (Roche 1669893), using a luminometer (Turner 20/20TD). Total cellular protein concentration was determined by the bicinchoninic acid method according to the manufacturer's instructions (Sigma B-9643), and used to normalize the luciferase data.

Results

Figure 8:
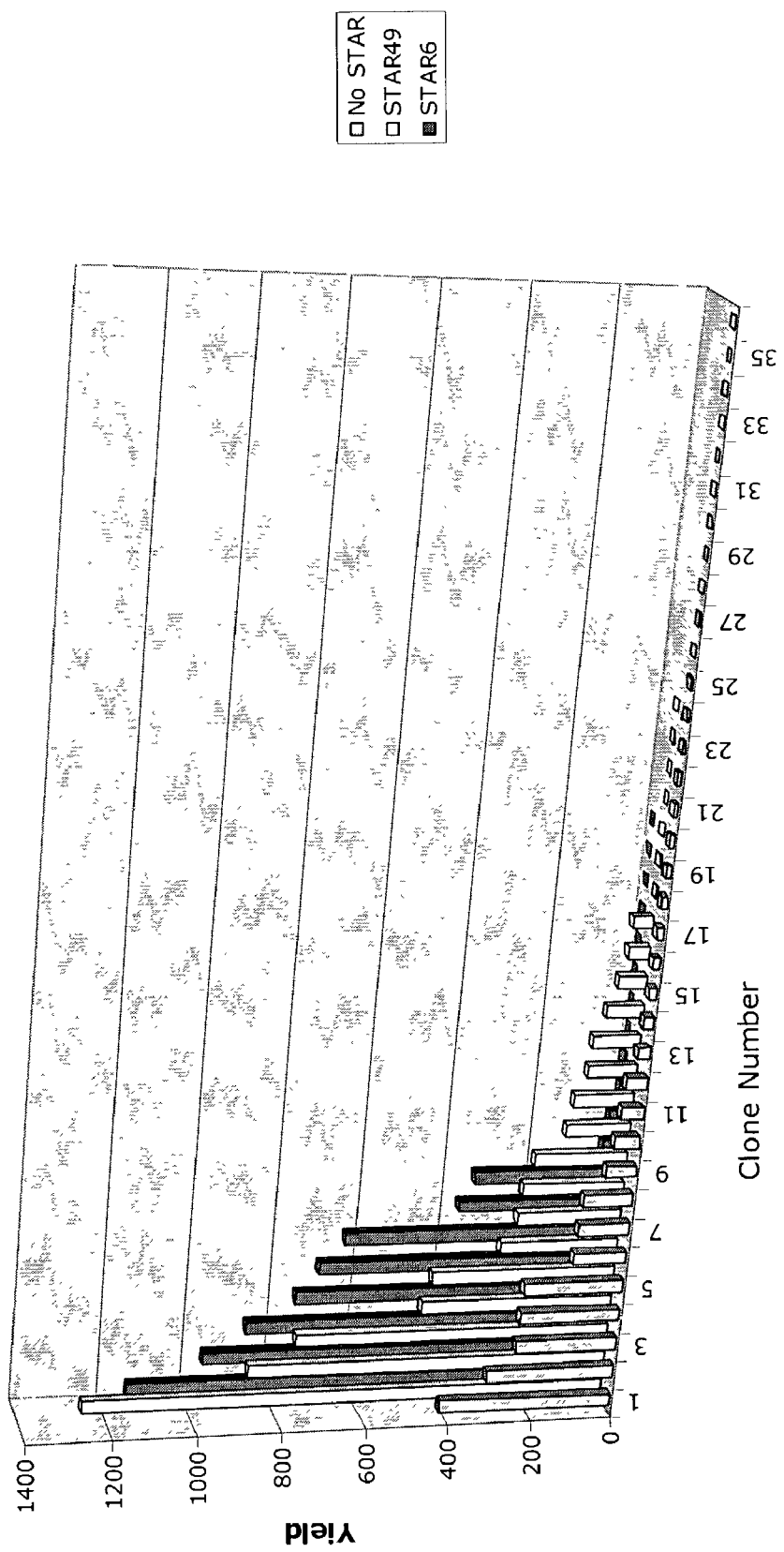
FIG. 8. STAR6 (SEQ ID NO:6) and STAR49 (SEQ ID NO:49) improve predictability and yield of transgene expression. Expression of SEAP from the CMV promoter by CHO cells transfected with pSDH-CSP, pSDH-CSP-STAR6, or pSDH-CSP-STAR49 was determined. The STAR-containing constructs confer greater predictability and elevated yield relative to the pSDH-CSP construct alone.

Recombinant CHO cell clones containing the pSDH-CSP vector, or pSDH-CSP plasmids containing STAR6 (SEQ ID NO:6) or STAR49 (SEQ ID NO:49)(Table 6), were cultured for 3 weeks. The SEAP activity in the culture supernatants was then determined, and is expressed on the basis of cell number (FIG. 8). As can be seen, clones with STAR elements in the expression units were isolated that express 2–3 fold higher SEAP activity than clones whose expression units do not include STAR elements. Furthermore, the number of STAR-containing clones that express SEAP activity at or above the maximal activity of the STAR-less clones is quite high: 25% to 40% of the STAR clone populations exceed the highest SEAP expression of the pSDH-CSP clones.

Recombinant U-2 OS cell clones containing the pSDH-CMV vector, or pSDH-CMV plasmids containing STAR6 (SEQ ID NO:6) or STAR8 (SEQ ID NO:8)(Table 6), were cultured for 3 weeks. The luciferase activity in the host cells was then determined, and is expressed as relative luciferase units (FIG. 9), normalized to total cell protein. The recombinant U-2 OS clones with STAR elements flanking the expression units had higher yields than the STAR-less clones: the highest expression observed from STAR8 (SEQ ID NO:8) clones was 2–3 fold higher than the expression from STAR-less clones. STAR6 (SEQ ID NO:6) clones had maximal expression levels 5 fold higher than the STAR-less clones. The STAR elements conferred greater predictability as well: for both STAR elements, 15 to 20% of the clones displayed luciferase expression at levels comparable to or greater than the STAR-less clone with the highest expression level.

These results demonstrate that, when used with the strong CMV promoter, STAR elements increase the yield of heterologous proteins (luciferase and SEAP). All three of the STAR elements introduced in this example provide elevated yields. The increased predictability conferred by the STAR elements is manifested by the large proportion of the clones with yields equal to or greater than the highest yields displayed by the STAR-less clones.

Example 12

STAR Elements Improve the Stability of Transgene Expression

During cultivation of recombinant host cells, it is common practice to maintain antibiotic selection. This is intended to prevent transcriptional silencing of the transgene, or loss of the transgene from the genome by processes such as recombination. However it is undesirable for production of heterologous proteins, for a number of reasons. First, the antibiotics that are used are quite expensive, and contribute significantly to the unit cost of the product. Second, for biopharmaceutical use, the protein must be demonstrably pure, with no traces of the antibiotic in the product. One advantage of STAR elements for heterologous protein production is that they confer stable expression on transgenes during prolonged cultivation, even in the absence of antibiotic selection; this property is demonstrated in this example.

Materials and Methods

The U-2 OS cell line was transfected with the plasmid pSDH-Tet-STAR6 and cultivated as described in Example 11. Individual puromycin-resistant clones were isolated and cultivated further in the absence of doxycycline. At weekly intervals the cells were transferred to fresh culture vessels at a dilution of 1:20. Luciferase activity was measured at periodic intervals as described in Example 11. After 15 weeks the cultures were divided into two replicates; one replicate continued to receive puromycin, while the other replicate received no antibiotic for the remainder of the experiment (25 weeks total).

Results

Table 7 presents the data on luciferase expression by an expression unit flanked with STAR6 (SEQ ID NO:6) during prolonged growth with or without antibiotic. As can be seen, the expression of the reporter transgene, luciferase, remains stable in the U-2 OS host cells for the duration of the experiment. After the cultures were divided into two treatments (plus antibiotic and without antibiotic) the expression of luciferase was essentially stable in the absence of antibiotic selection. This demonstrates the ability of STAR elements to protect transgenes from silencing or loss during prolonged cultivation. It also demonstrates that this property is independent of antibiotic selection. Therefore production of heterologous proteins is possible without incurring the costs of the antibiotic or of difficult downstream processing Example 13

Minimal Essential Sequences of STAR Elements

STAR elements are isolated from the genetic screen described in Example 1. The screen uses libraries constructed with human genomic DNA that was size-fractionated to approximately 0.5–2 kilobases (supra). The STAR elements range from 500 to 2361 base pairs (Table 6). It is likely that, for many of the STAR elements that have been isolated, STAR activity is conferred by a smaller DNA fragment than the initially isolated clone. It is useful to determine these minimum fragment sizes that are essential for STAR activity, for two reasons. First, smaller functional STAR elements would be advantageous in the design of compact expression vectors, since smaller vectors transfect host cells with higher efficiency. Second, determining minimum essential STAR sequences permits the modification of those sequences for enhanced functionality. Two STAR elements have been fine-mapped to determine their minimal essential sequences.

Figure 10:
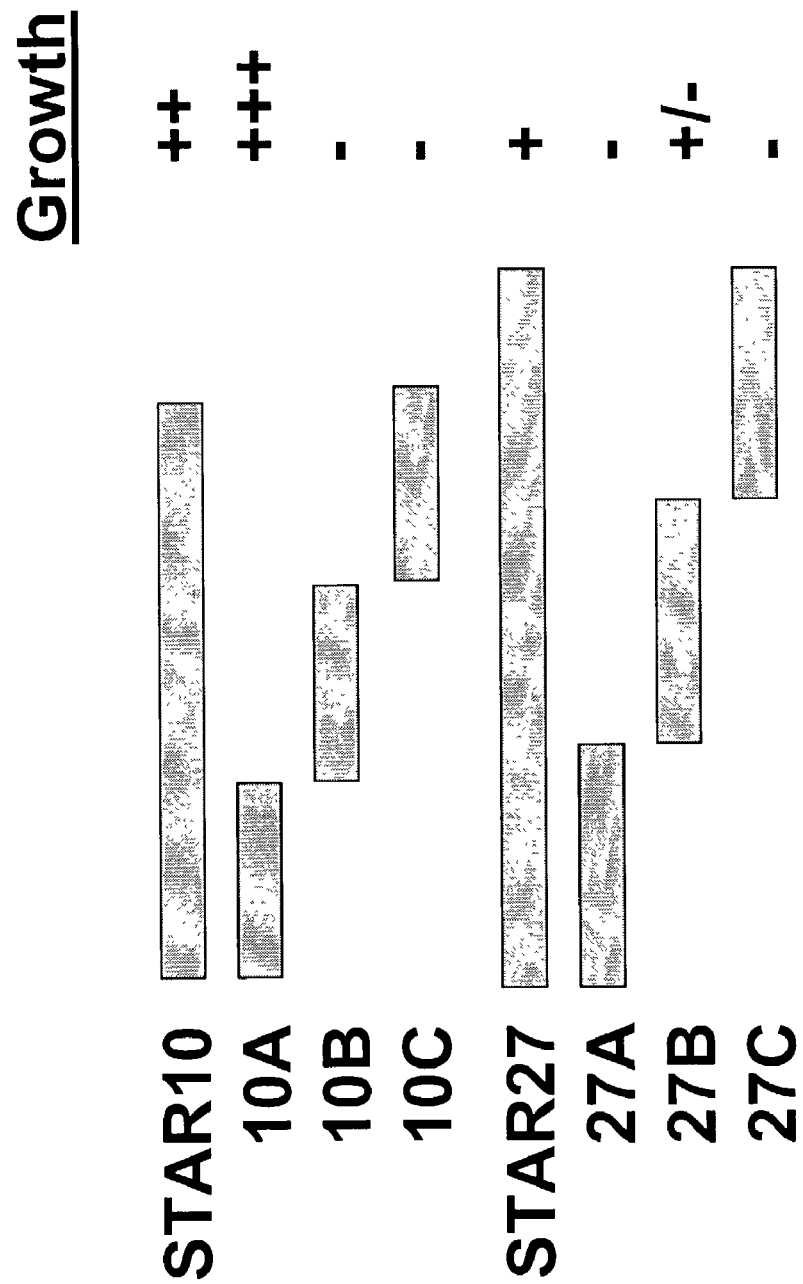
FIG. 10. Minimal essential sequences of STAR10 (SEQ ID NO:10) and STAR27 (SEQ ID NO:27). Portions of the STAR elements were amplified by PCR: STAR10 (SEQ ID NO:10) was amplified with primers E23 (SEQ ID NO:169) and E12 (SEQ ID NO:158) to yield fragment 10A, E13 (SEQ ID NO:159) and E14 (SEQ ID NO:160) to yield fragment 10B, and E15 (SEQ ID NO:161) and E16 (SEQ ID NO:162) to yield fragment 10C. STAR27 (SEQ ID NO:27) was amplified with primers E17 (SEQ ID NO:163) and E18 (SEQ ID NO:164) to yield fragment 27A, E19 (SEQ ID NO:166) and E20 (SEQ ID NO:166) to yield fragment 27B, and E21 (SEQ ID NO:167) and E22 (SEQ ID NO:168) to yield fragment 27C. These sub-fragments were cloned into the pSelect vector. After transfection into U-2 OS/Tet-Off/LexA-HP1 cells, the growth of the cultures in the presence of zeocin was monitored. Growth rates varied from vigorous (+++) to poor (+/−), while some cultures failed to survive zeocin treatment (−) due to absence of STAR activity in the DNA fragment tested.

Materials and Methods:

STAR10 (SEQ ID NO:10)(1167 base pairs) and STAR27 (SEQ ID NO:27) (1520 base pairs) have been fine-mapped. They have been amplified by PCR to yield sub-fragments of approximately equal length (FIG. 10 legend). For initial testing, these have been cloned into the pSelect vector at the BamHI site, and transfected into U-2 OS/Tet-Off/LexA-HP1 cells as described in Example 1. After selection for hygromycin resistance, LexA-HP1 was induced by lowering the doxycycline concentration. Transfected cells were then incubated with zeocin to test the ability of the STAR fragments to protect the SV40-Zeo expression unit from repression due to LexA-HP1 binding.

Results

In this experiment STAR10 (SEQ ID NO:10) and STAR 27 (SEQ ID NO:27) confer good protection against gene silencing, as expected (FIG. 10). This is manifested by robust growth in the presence of zeocin.

Of the 3 STAR10 sub-fragments, 10A (~400 base pairs) confers on transfected cells vigorous growth in the presence of zeocin, exceeding that of the full-length STAR element. Cells transfected with pSelect constructs containing the other 2 sub-fragments do not grow in the presence of zeocin. These results identify the ~400 base pair 10A fragment as encompassing the DNA sequence responsible for the anti-repression activity of STAR10.

STAR27 (SEQ ID NO:27) confers moderate growth in zeocin to transfected cells in this experiment (FIG. 10). One of the sub-fragments of this STAR, 27B (~500 base pairs), permits weak growth of the host cells in zeocin-containing medium. This suggests that the anti-repression activity of this STAR is partially localized on sub-fragment 27B, but full activity requires sequences from 27A and/or 27C (each ~500 base pairs) as well.

Example 14

STAR Elements Function in Diverse Strains of Cultured Mammalian Cells

The choice of host cell line for heterologous protein expression is a critical parameter for the quality, yield, and unit cost of the protein. Considerations such as post-translational modifications, secretory pathway capacity, and cell line immortality dictate the appropriate cell line for a particular biopharmaceutical production system. For this reason, the advantages provided by STAR elements in terms of yield, predictability, and stability should be obtainable in diverse cell lines. This was tested by comparing the function of STAR6 (SEQ ID NO:6) in the human U-2 OS cell line in which it was originally cloned, and the CHO cell line which is widely applied in biotechnology.

Materials and Methods:

The experiments of Example 11 are referred to.

Results

Figure 9:
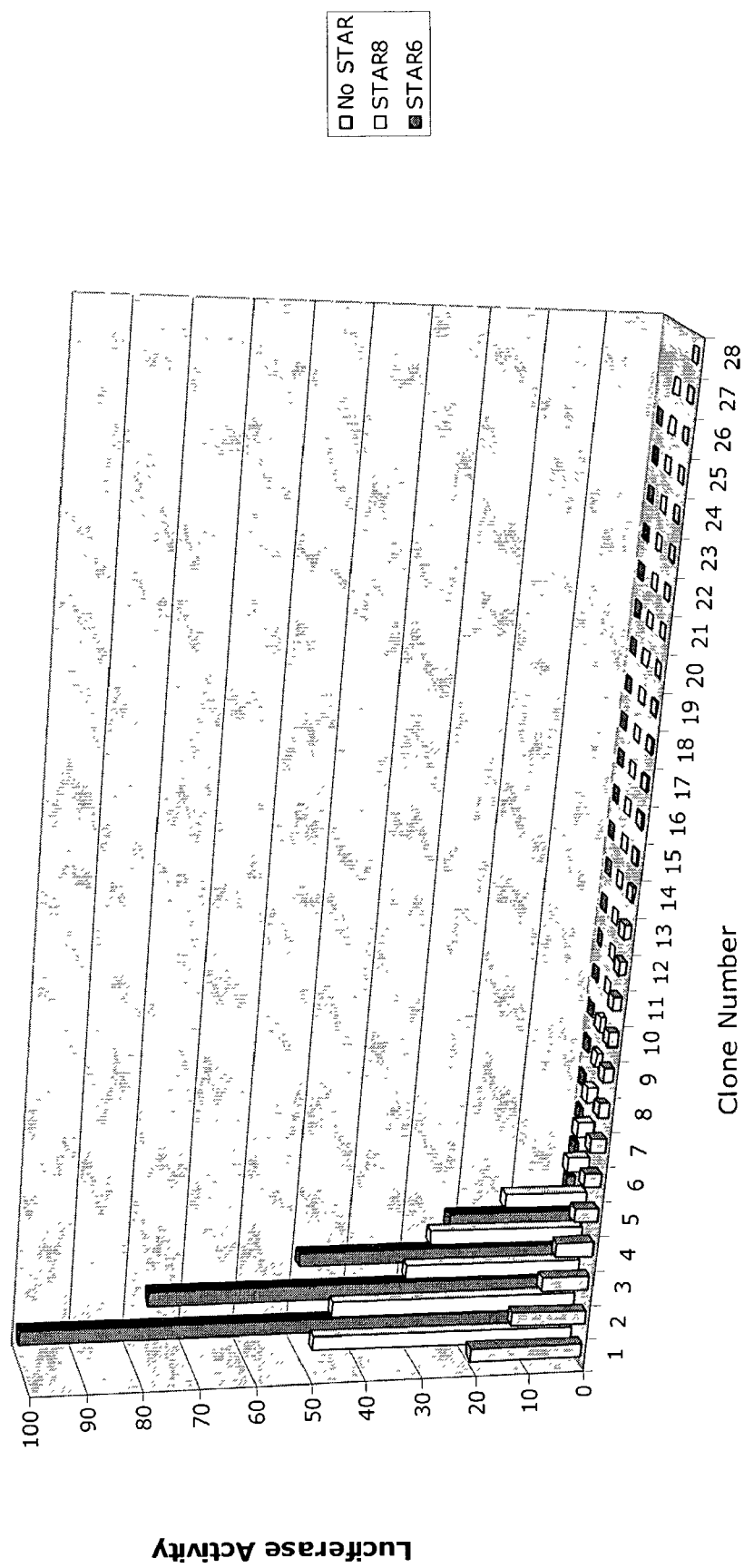
FIG. 9. STAR6 (SEQ ID NO:6) and STAR8 (SEQ ID NO:8) improve predictability and yield of transgene expression. Expression of luciferase from the CMV promoter by U-2 OS cells transfected with pSDH-CMV, pSDH-CMV-STAR6, or pSDH-CMV-STAR8 was determined. The STAR-containing constructs confer greater predictability and elevated yield relative to the pSDH-CMV construct alone.

The expression of the SEAP reporter gene in CHO cells is presented in FIG. 8; the expression of the luciferase reporter gene in U-2 OS cells is presented in FIG. 9. By comparison of the results of these two experiments, it is apparent that the STAR6 element (SEQ ID NO:6) is functional in both cell lines: reporter gene expression was more predictable in both of them, and clones of each cell line displayed higher yields, when the reporter gene was shielded from position effects by STAR6 (SEQ ID NO:6). These two cell lines are derived from different species (human and hamster) and different tissue types (bone and ovary), reflecting the broad range of host cells in which this STAR element can be utilized in improving heterologous protein expression.

Example 15

STAR Elements Function in the Context of Various Transcriptional Promoters

Transgene transcription is achieved by placing the transgene open reading frame under control of an exogenous promoter. The choice of promoter is influenced by the nature of the heterologous protein and the production system. In most cases, strong constitutive promoters are preferred because of the high yields they can provide. Some viral promoters have these properties; the promoter/enhancer of the cytomegalovirus immediate early gene ("CMV promoter") is generally regarded as the strongest promoter in common biotechnological use (Boshart et al., 1985, Doll et al., 1996, Foecking & Hofstetter, 1986). The simian virus SV40 promoter is also moderately strong (Boshart et al., 1985, Foecking & Hofstetter, 1986) and is frequently used for ectopic expression in mammalian cell vectors. The Tet-Off promoter is inducible: the promoter is repressed in the presence of tetracycline or related antibiotics (doxycycline is commonly used) in cell-lines which express the tTA plasmid (Clontech K1620-A), and removal of the antibiotic results in transcriptional induction (Deuschle et al., 1995, Gossen & Bujard, 1992, Izumi & Gilbert, 1999, Umana et al., 1999).

Materials and Methods:

The construction of the pSDH-Tet and pSDH-CMV vectors is described in Example 11. pSDH-SV40 was constructed by PCR amplification of the SV40 promoter (primers D41 and D42) from plasmid pSelect-SV40-Zeo (Example 1), followed by digestion of the PCR product with SacII and SalI. The pSDH-CMV vector was digested with SacII and SalI to remove the CMV promoter, and the vector and SV40 fragment were ligated together to create pSDH-SV40. STAR6 (SEQ ID NO:6) was cloned into MCSI and MCSII as described in Example 11. The plasmids pSDH-Tet, pSDH-Tet-STAR6, pSDH-Tet-STAR7, pSDH-SV40 and pSDH-SV40-STAR6 were co-transfected with pBabe-Puro into U-2 OS using SuperFect as described by the manufacturer. Cell cultivation, puromycin selection, and luciferase assays were carried out as described in Example 11.

Results

Figure 11:
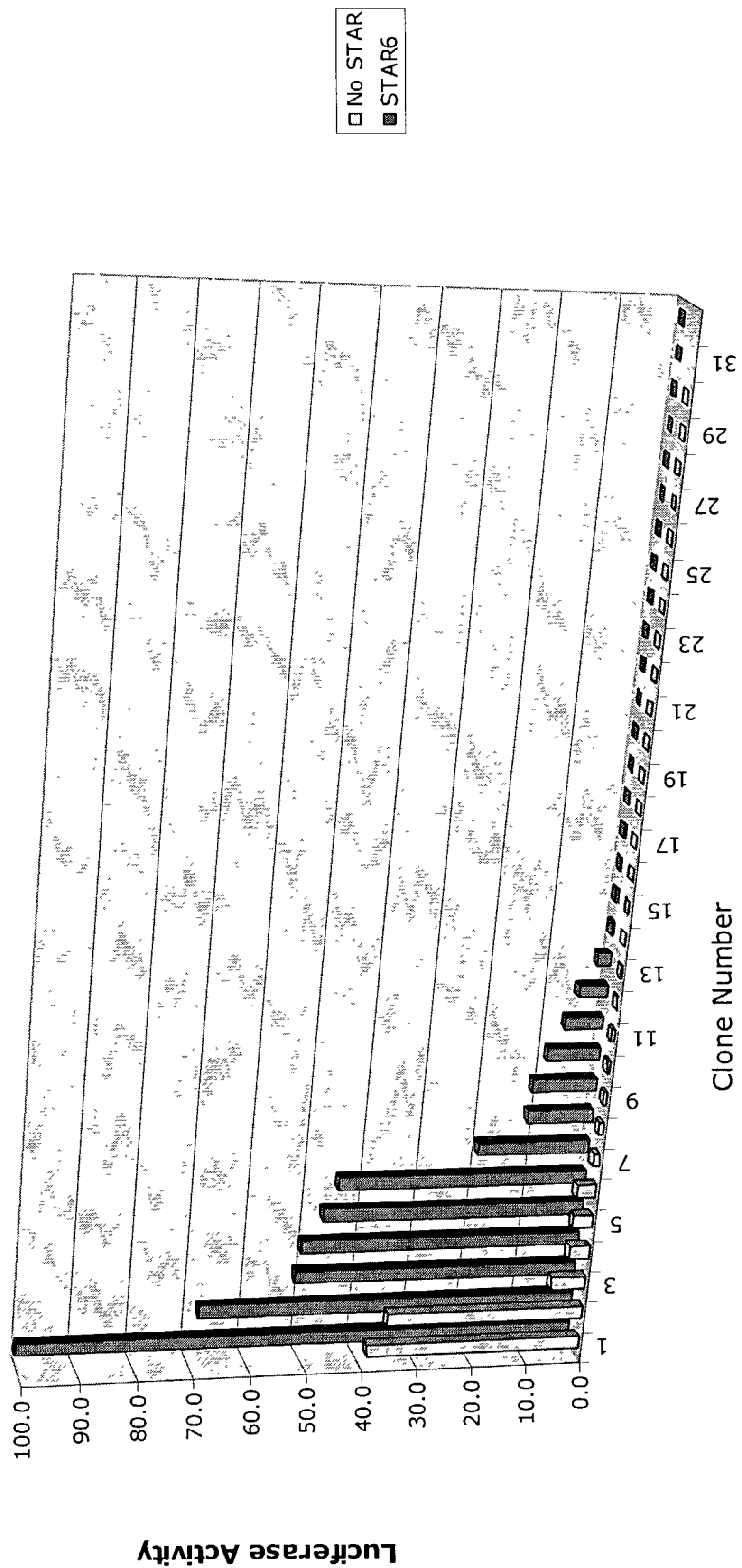
FIG. 11. STAR element function in the context of the SV40 promoter. pSDH-SV40 and pSDH-SV40-STAR6 were transfected into the human osteosarcoma U-2 OS cell line, and expression of luciferase was assayed with or without protection from gene silencing by STAR6 (SEQ ID NO:6) in puromycin-resistant clones.
Figure 12:
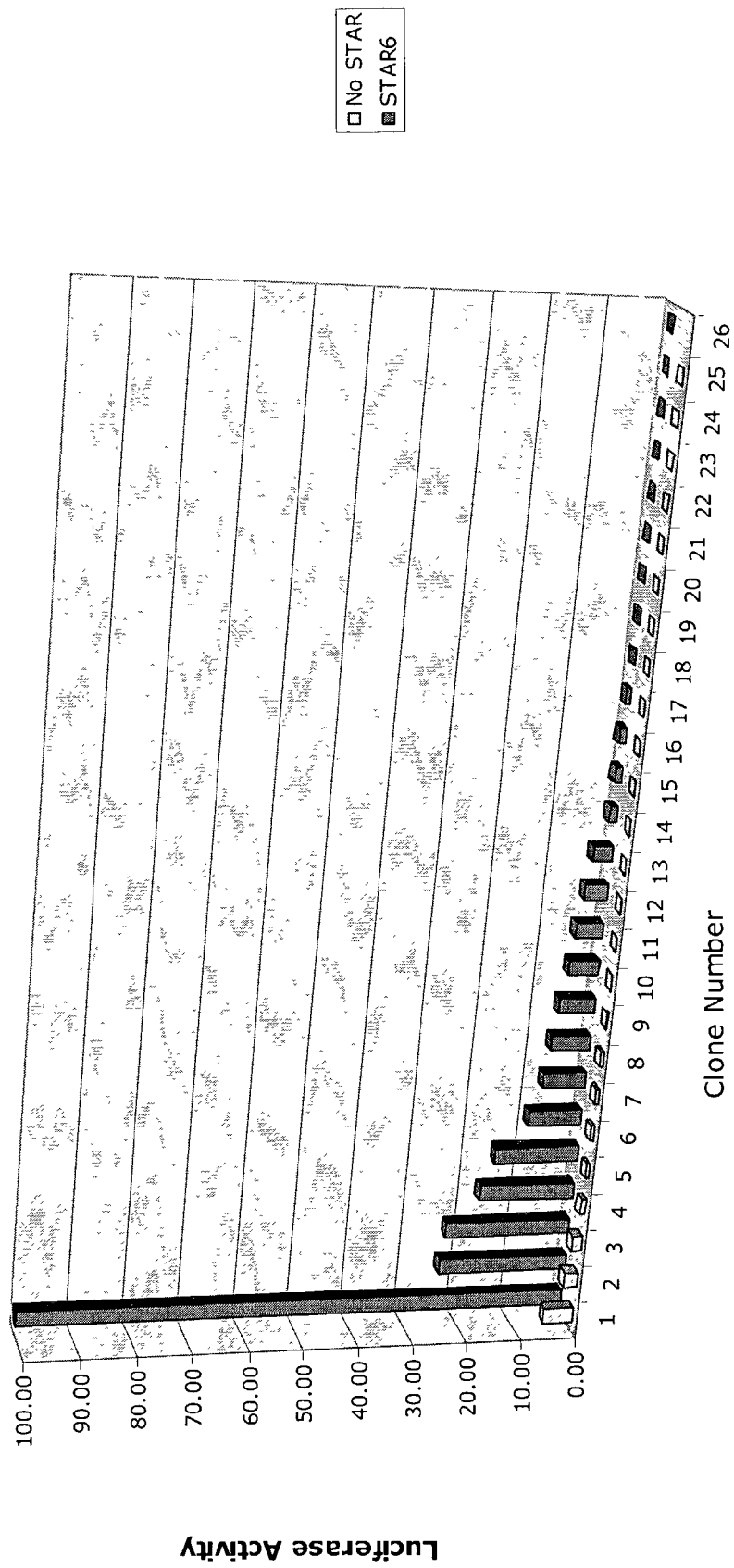
FIG. 12. STAR element function in the context of the Tet-Off promoter. pSDH-Tet and pSDH-Tet-STAR6 were transfected into the human osteosarcoma U-2 OS cell line, and expression of luciferase was assayed with or without protection from gene silencing by STAR6 (SEQ ID NO:6) in puromycin-resistant clones.

FIGS. 9, 11, and 12 compare the expression of the luciferase reporter gene from 3 different promoters: two strong and constitutive viral promoters (CMV and SV40), and the inducible Tet-Off promoter. All three promoters were tested in the context of the STAR6 (SEQ ID NO:6) element in U-2 OS cells. The results demonstrate that the yield and predictability from all 3 promoters are increased by STAR6 (SEQ ID NO:6). As described in Examples 11 and 14, STAR6 (SEQ ID NO:6) is beneficial in the context of the CMV promoter (FIG. 9). Similar improvements are seen in the context of the SV40 promoter (FIG. 11): the yield from the highest-expressing STAR6 (SEQ ID NO:6) clone is 2–3 fold greater than the best pSDH-SV40 clones, and 6 STAR clones (20% of the population) have yields higher than the best STAR-less clones. In the context of the Tet-Off promoter under inducing (low doxycycline) concentrations, STAR6 also improves the yield and predictability of transgene expression (FIG. 12): the highest-expressing STAR6 (SEQ ID NO:6) clone has a 20-fold higher yield than the best pSDH-Tet clone, and 9 STAR6 (SEQ ID NO:6) clones (35% of the population) have yields higher than the best STAR-less clone. It is concluded that this STAR element is versatile in its transgene-protecting properties, since it functions in the context of various biotechnologically useful promoters of transcription.

Example 16

STAR Element Function can be Directional

While short nucleic acid sequences can be symmetrical (e.g., palindromic), longer naturally-occurring sequences are typically asymmetrical. As a result, the information content of nucleic acid sequences is directional, and the sequences themselves can be described with respect to their 5' and 3' ends. The directionality of nucleic acid sequence information affects the arrangement in which recombinant DNA molecules are assembled using standard cloning techniques known in the art (Sambrook et al., 1989). STAR elements are long, asymmetrical DNA sequences, and have a directionality based on the orientation in which they were originally cloned in the pSelect vector. In the examples given above, using two STAR elements in pSDH vectors, this directionality was preserved. This orientation is described as the native or 5'-3' orientation, relative to the zeocin resistance gene (see FIG. 13). In this example the importance of directionality for STAR function is tested in the pSDH-Tet vector. Since the reporter genes in the pSDH vectors are flanked on both sides by copies of the STAR element of interest, the orientation of each STAR copy must be considered. This example compares the native orientation with the opposite orientation (FIG. 13).

Materials and Methods:

The STAR66 element (SEQ ID NO:66) was cloned into pSDH-Tet as described in Example 11. U-2 OS cells were co-transfected with plasmids pSDH-Tet-STAR66-native and pSDH-Tet-STAR66-opposite, and cultivated as described in Example 11. Individual clones were isolated and cultivated; the level of luciferase expression was determined as described (supra).

Results

Figure 14:
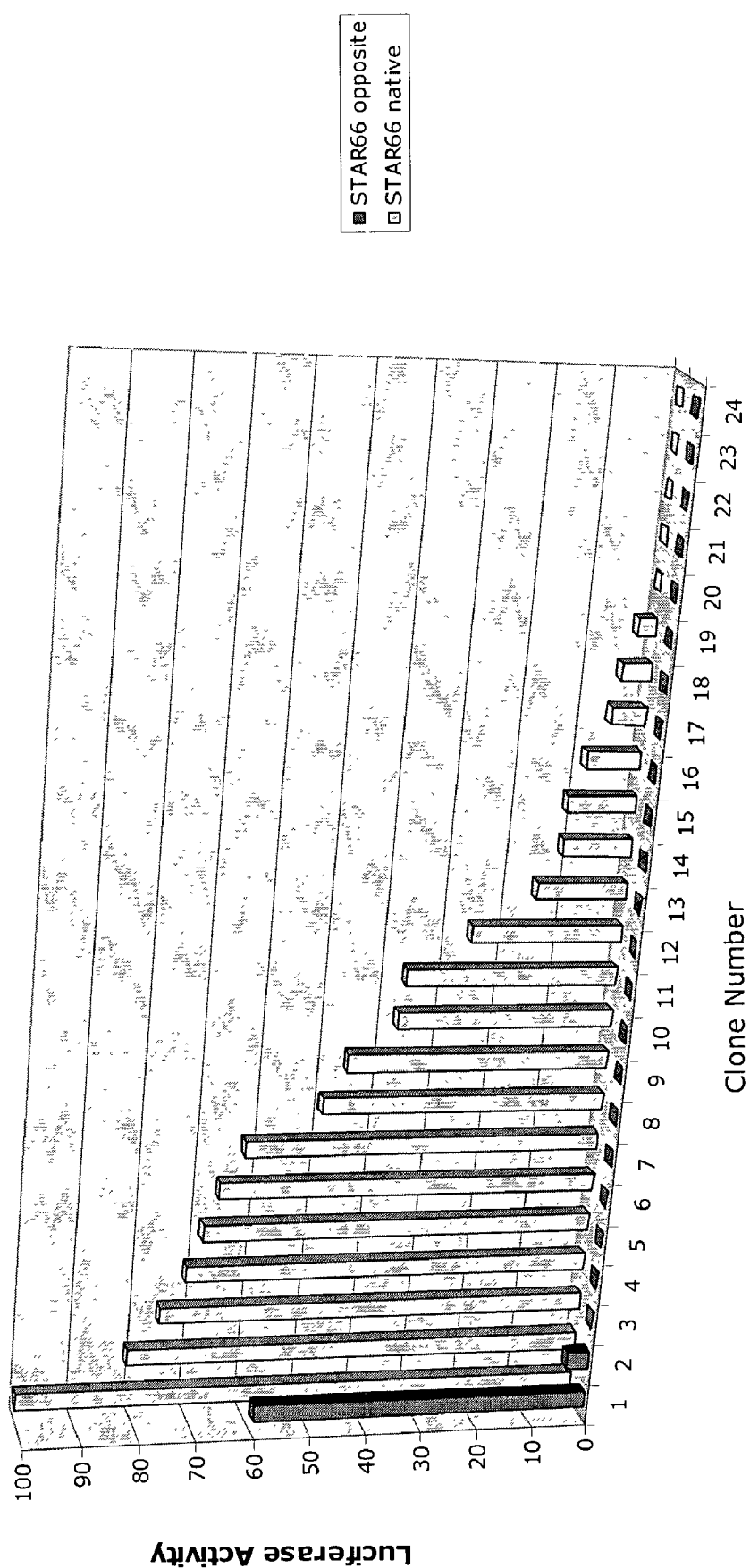
FIG. 14. Directionality of STAR66 function. The STAR66 element was cloned into pSDH-Tet in either the native (STAR66 native (SEQ ID NO:66)) or the opposite orientation (STAR66 opposite (SEQ ID NO:67)), and transfected into U-2 OS cells. Luciferase activity was assayed in puromycin resistant clones.

The results of the comparison of STAR66 activity in the native orientation (SEQ ID NO:66) and the opposite orientation (SEQ ID NO:67) are shown in FIG. 14. When STAR66 is in the opposite orientation (SEQ ID NO:67), the yield of only one clone is reasonably high (60 luciferase units). In contrast, the yield of the highest-expressing clone when STAR66 is in the native orientation (SEQ ID NO:66) is considerably higher (100 luciferase units), and the predictability is much higher as well: 7 clones of the native-orientation population (30%) express luciferase above the level of the highest-expressing clone from the opposite-orientation population, and 15 of the clones in the native-orientation population (60%) express luciferase above 10 relative luciferase units. Therefore it is demonstrated that STAR66 function is directional.

Example 17

Transgene Expression in the Context of STAR Elements is Copy Number-Dependent

Transgene expression units for heterologous protein expression are generally integrated into the genome of the host cell to ensure stable retention during cell division. Integration can result in one or multiple copies of the expression unit being inserted into the genome; multiple copies may or may not be present as tandem arrays. The increased yield demonstrated for transgenes protected by STAR elements (supra) suggests that STAR elements are able to permit the transgene expression units to function independently of influences on transcription associated with the site of integration in the genome (independence from position effects (Boivin & Dura, 1998)). It suggests further that the STAR elements permit each expression unit to function independently of neighboring copies of the expression unit when they are integrated as a tandem array (independence from repeat-induced gene silencing (Garrick et al., 1998)). Copy number-dependence is determined from the relationship between transgene expression levels and copy number, as described in the example below.

Figure 15:
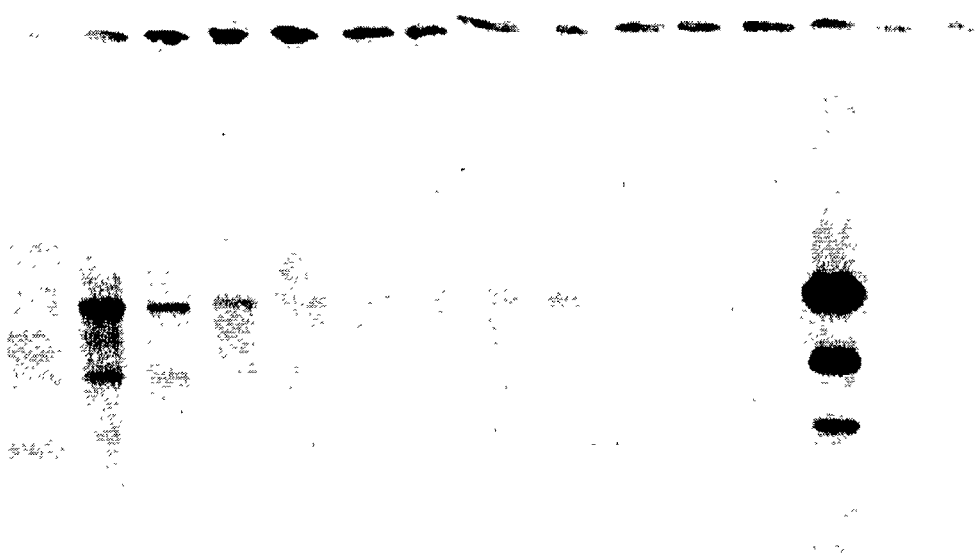
FIG. 15. Copy number-dependence of STAR function. Southern blot of luciferase expression units in pSDH-Tet-STAR10, integrated into U-2 OS genomic DNA. Radioactive luciferase DNA probe was used to detect the amount of transgene DNA in the genome of each clone, which was then quantified with a phosphorimager.

Materials and Methods:

U-2 OS cells were co-transfected with pSDH-Tet-STAR10 and cultivated under puromycin selection as described (supra). Eight individual clones were isolated and cultivated further. Then cells were harvested, and one portion was assayed for luciferase activity as described (supra). The remaining cells were lysed and the genomic DNA purified using the DNeasy Tissue Kit (QIAGEN 69504) as described by the manufacturer. DNA samples were quantitated by UV spectrophotometry. Three micrograms of each genomic DNA sample were digested with PvuII and XhoI overnight as described by the manufacturer (New England Biolabs), and resolved by agarose gel electrophoresis. DNA fragments were transferred to a nylon membrane as described (Sambrook et al., 1989), and hybridized with a radioactively labelled probe to the luciferase gene (isolated from BamHI/SacII-digested pSDH-Tet). The blot was washed as described (Sambrook et al., 1989) and exposed to a phosphorimager screen (Personal F/X, BioRad). The resulting autoradiogram (FIG. 15) was analyzed by densitometry to determine the relative strength of the luciferase DNA bands, which represents the transgene copy number.

Results

Figure 16:
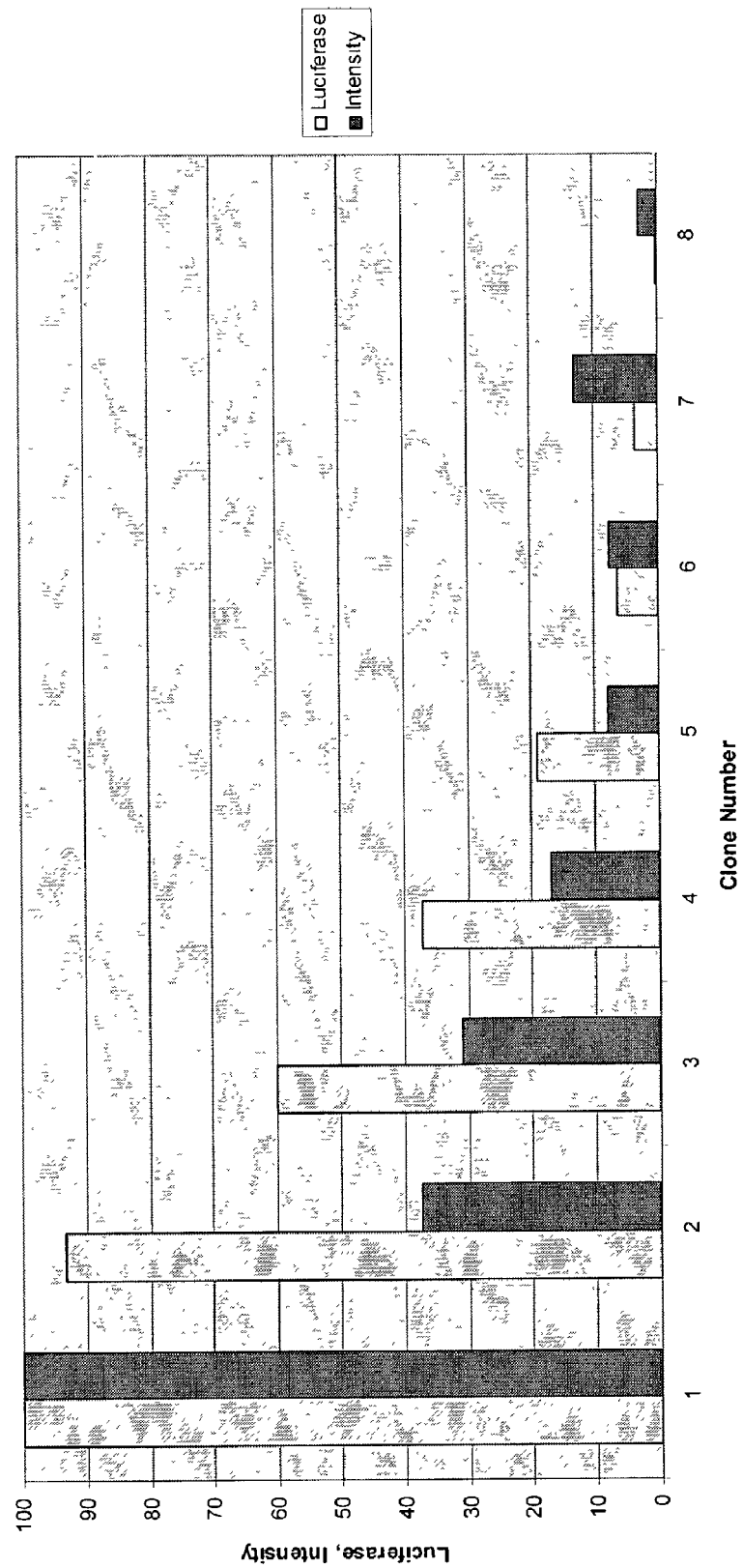
FIG. 16. Copy number-dependence of STAR function. The copy number of pSDH-Tet-STAR10 expression units in each clone was determined by phosphorimagery, and compared with the activity of the luciferase reporter enzyme expressed by each clone.

The enzyme activities and copy numbers (DNA band intensities) of luciferase in the clones from the pSDH-Tet-STAR10 clone population is shown in FIG. 16. The transgene copy number is highly correlated with the level of luciferase expression in these pSDH-Tet-STAR10 clones (SEQ ID NO:0)(r=0.86). This suggests that STAR10 (SEQ ID NO:10) confers copy number-dependence on the transgene expression units, making transgene expression independent of other transgene copies in tandem arrays, and independent of gene-silencing influences at the site of integration.

Example 18

STAR Elements Function as Enhancer Blockers But not Enhancers

Gene promoters are subject to both positive and negative influences on their ability to initiate transcription. An important class of elements that exert positive influences are enhancers. Enhancers are characteristically able to affect promoters even when they are located far away (many kilobase pairs) from the promoter. Negative influences that act by heterochromatin formation (e.g., Polycomb group proteins) have been described above, and these are the target of STAR activity. The biochemical basis for enhancer function and for heterochromatin formation is fundamentally similar, since they both involve binding of proteins to DNA. Therefore it is important to determine whether STAR elements are able to block positive influences as well as negative influences, in other words, to shield transgenes from genomic enhancers in the vicinity of the site of integration. The ability to shield transgenes from enhancer activity ensures stable and predictable performance of transgenes in biotechnological applications. This example examines the performance of STAR elements in an enhancer-blocking assay.

Another feature of STAR activity that is important to their function is the increased yield they confer on transgenes (Example 11). STARs are isolated on the basis of their ability to maintain high levels of zeocin expression when heterochromatin-forming proteins are bound adjacent to the candidate STAR elements. High expression is predicted to occur because STARs are anticipated to block the spread of heterochromatin into the zeocin expression unit. However, a second scenario is that the DNA fragments in zeocin-resistant clones contain enhancers. Enhancers have been demonstrated to have the ability to overcome the repressive effects of Polycomb-group proteins such as those used in the method of the STAR screen (Zink & Paro, 1995). Enhancers isolated by this phenomenon would be considered false positives, since enhancers do not have the properties claimed here for STARs. In order to demonstrate that STAR elements are not enhancers, they have been tested in an enhancer assay.

Figure 17:
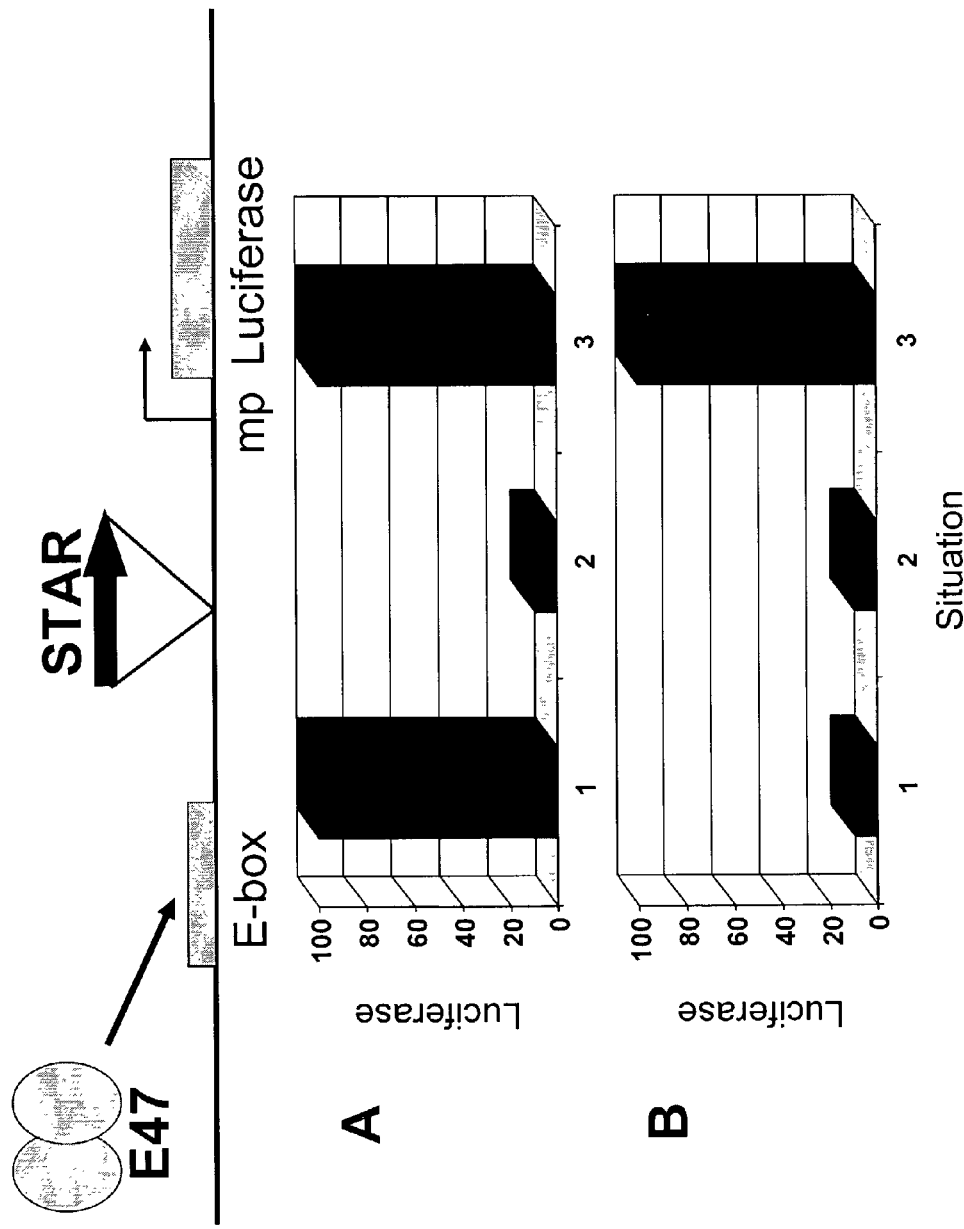
FIG. 17. Enhancer-blocking and enhancer assays. The luciferase expression vectors used for testing STARs for enhancer-blocking and enhancer activity are shown schematically. The E-box binding site for the E47 enhancer protein is upstream of a cloning site for STAR elements. Downstream of the STAR cloning site is the luciferase gene under control of a human alkaline phosphatase minimal promoter (mp). The histograms indicate the expected outcomes for the three possible experimental situations (see text). Panel A: Enhancer-blocking assay. Panel B: Enhancer assay.

The enhancer-blocking assay and the enhancer assay are methodologically and conceptually similar. The assays are shown schematically in FIG. 17. The ability of STAR elements to block enhancers is performed using the E47/E-box enhancer system. The E47 protein is able to activate transcription by promoters when it is bound to an E-box DNA sequence located in the vicinity of those promoters (Quong et al., 2002). E47 is normally involved in regulation of B and T lymphocyte differentiation (Quong et al., 2002), but it is able to function in diverse cell types when expressed ectopically (Petersson et al., 2002). The E-box is a palindromic DNA sequence, CANNTG (Knofler et al., 2002). In the enhancer-blocking assay, an E-box is placed upstream of a luciferase reporter gene (including a minimal promoter) in an expression vector. A cloning site for STAR elements is placed between the E-box and the promoter. The E47 protein is encoded on a second plasmid. The assay is performed by transfecting both the E47 plasmid and the luciferase expression vector into cells; the E47 protein is expressed and binds to the E-box, and the E47/E-box complex is able to act as an enhancer. When the luciferase expression vector does not contain a STAR element, the E47/E-box complex enhances luciferase expression (FIG. 17A, situation 1). When STAR elements are inserted between the E-box and the promoter, their ability to block the enhancer is demonstrated by reduced expression of luciferase activity (FIG. 17A, situation 2); if STARs cannot block enhancers, luciferase expression is activated (FIG. 17A, situation 3).

The ability of STAR elements to act as enhancers utilizes the same luciferase expression vector. In the absence of E47, the E-box itself does not affect transcription. Instead, enhancer behaviour by STAR elements will result in activation of luciferase transcription. The assay is performed by transfecting the luciferase expression vector without the E47 plasmid. When the expression vector does not contain STAR elements, luciferase expression is low (FIG. 17B, situation 1). If STAR elements do not have enhancer properties, luciferase expression is low when a STAR element is present in the vector (FIG. 17B, situation 2). If STAR elements do have enhancer properties, luciferase expression will be activated in the STAR-containing vectors (FIG. 17B, situation 3).

Materials and Methods:

The luciferase expression vector was constructed by inserting the E-box and a human alkaline phosphatase minimal promoter from plasmid mu-E5+E2x6-cat(x) (Ruezinsky et al., 1991) upstream of the luciferase gene in plasmid pGL3-basic (Promega E1751), to create pGL3-E-box-luciferase (gift of W. Romanow). The E47 expression plasmid contains the E47 open reading frame under control of a beta-actin promoter in the pHBAPr-1-neo plasmid; E47 in constitutively expressed from this plasmid (gift of W. Romanow).

STAR elements 1 (SEQ ID NO:1), 2 (SEQ ID NO:2), 3 (SEQ ID NO:3), 6 (SEQ ID NO:6), 10 (SEQ ID NO:10), 11 (SEQ ID NO:11), 18 (SEQ ID NO:18), and 27 (SEQ ID NO:27) have been cloned into the luciferase expression vector. Clones containing the *Drosophila* scs element and the chicken beta-globin HS4-6x core ("HS4") element have been included as positive controls (they are known to block enhancers, and to have no intrinsic enhancer properties (Chung et al., 1993, Kellum & Schedl, 1992)), and the empty luciferase expression vector has been included as a negative control. All assays were performed using the U-2 OS cell line. In the enhancer-blocking assay, the E47 plasmid was co-transfected with the luciferase expression vectors (empty vector, or containing STAR or positive-control elements). In the enhancer assay, the E47 plasmid was co-transfected with STARless luciferase expression vector as a positive control for enhancer activity; all other samples received a mock plasmid during co-transfection. The transiently transfected cells were assayed for luciferase activity 48 hours after plasmid transfection (supra). The luciferase activity expressed from a plasmid containing no E-box or STAR/control elements was subtracted, and the luciferase activities were normalized to protein content as described (supra).

Results

Figure 18:
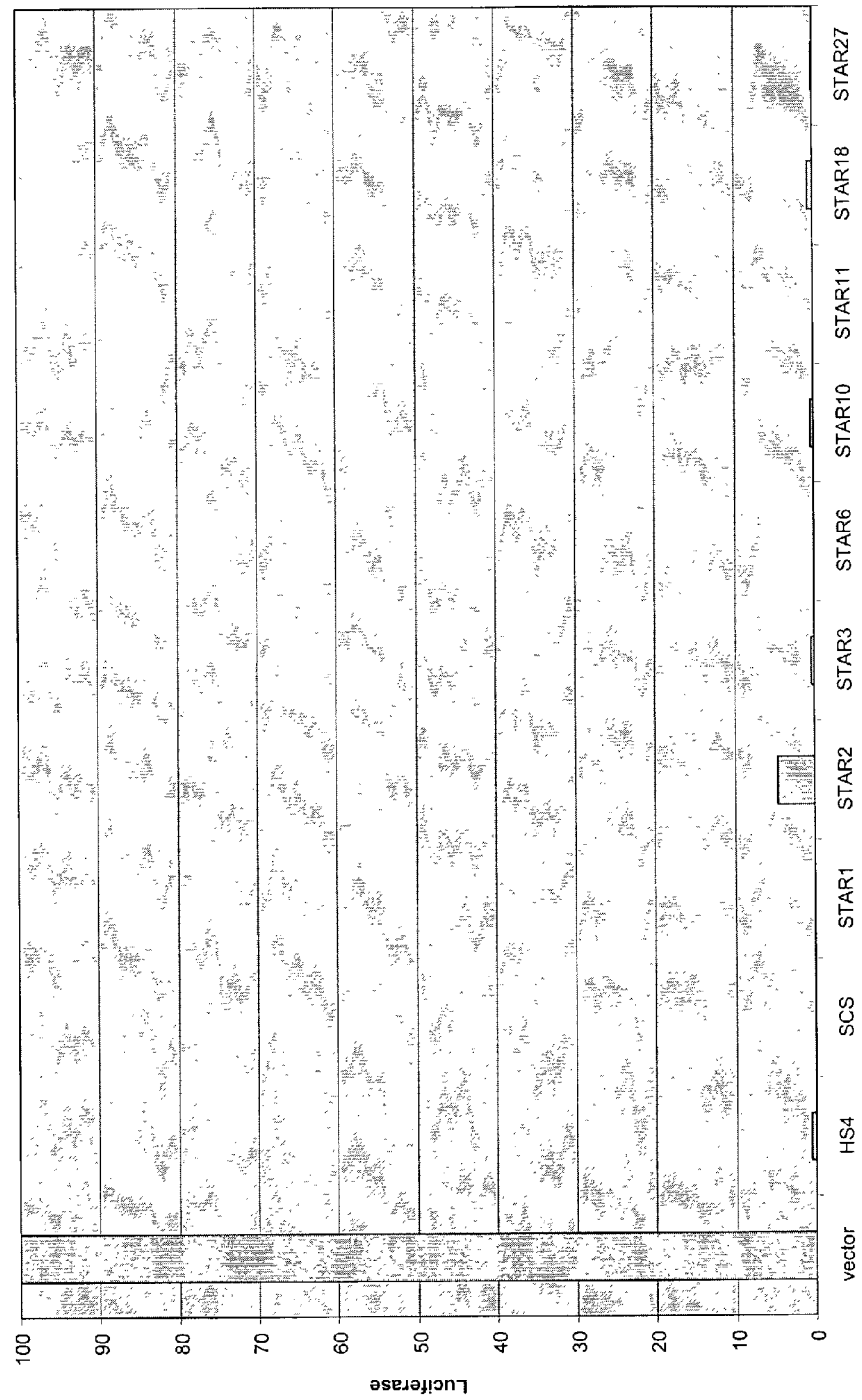
FIG. 18. Enhancer-blocking assay. Luciferase expression from a minimal promoter is activated by the E47/E-box enhancer in the empty vector (vector). Insertion of enhancer-blockers (scs, HS4) or STAR elements (STAR elements 1 (SEQ ID NO:1), 2 (SEQ ID NO:2), 3 (SEQ ID NO:3), 6 (SEQ ID NO:6), 10 (SEQ ID NO:10), 11 (SEQ ID NO:11), 18 (SEQ ID NO:18), and 27 (SEQ ID NO:27)) block luciferase activation by the E47/E-box enhancer.

FIG. 18 shows the results of the enhancer-blocking assay. In the absence of STAR elements (or the known enhancer-blocking elements scs and HS4), the E47/E-box enhancer complex activates expression of luciferase ("vector"); this enhanced level of expression has been normalized to 100. Enhancer activity is blocked by all STAR elements tested. Enhancer activity is also blocked by the HS4 and scs elements, as expected (Bell et al., 2001, Gerasimova & Corces, 2001). These results demonstrate that in addition to their ability to block the spreading of transcriptional silencing (negative influences), STAR elements are able to block the action of enhancers (positive influences).

Figure 19:
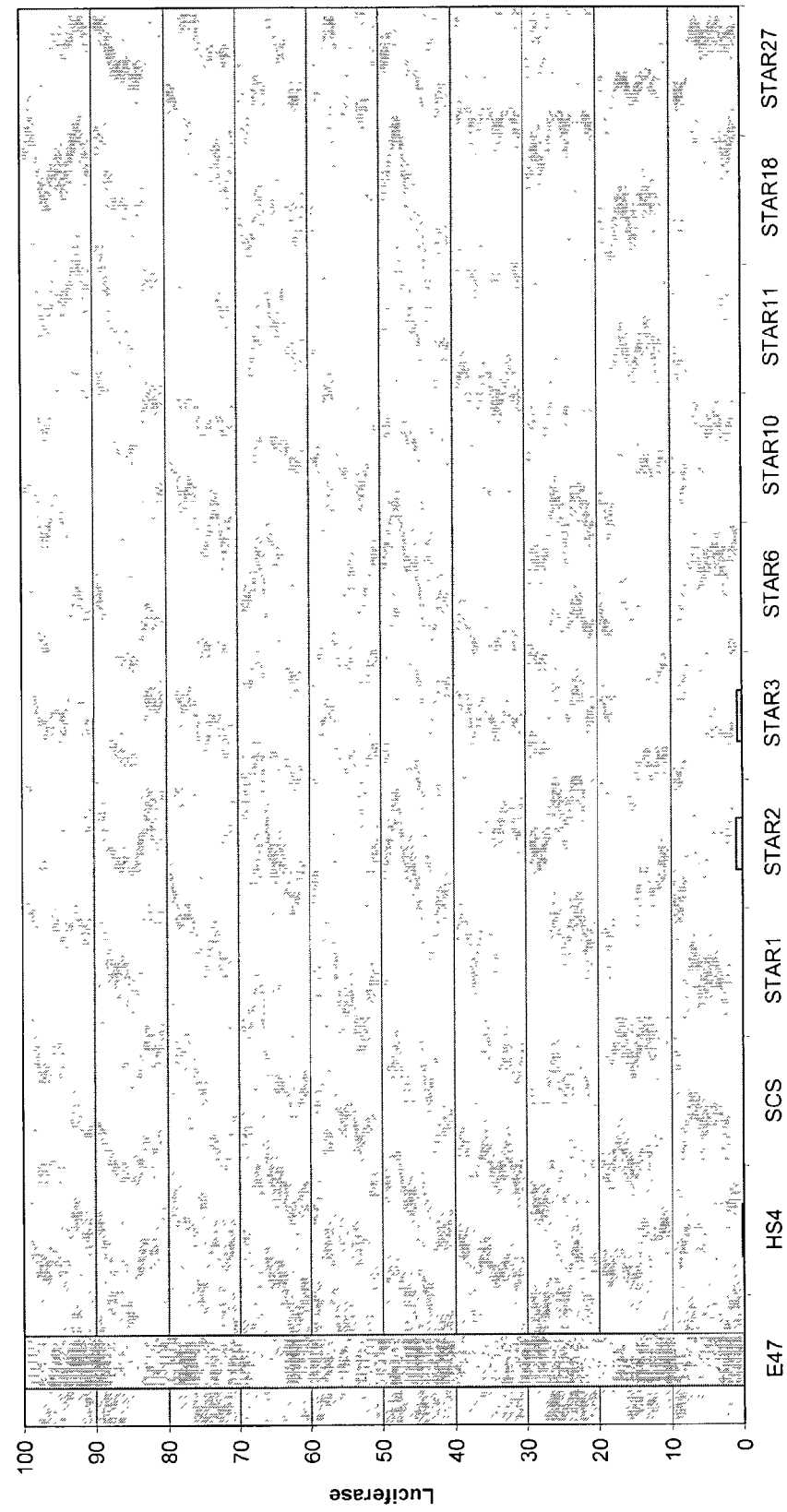
FIG. 19. Enhancer assay. Luciferase expression from a minimal promoter is activated by the E47/E-box enhancer in the empty vector (E47). Insertion of the scs and HS4 elements or various STAR elements (STARs 1 (SEQ ID NO:1), 2 (SEQ ID NO:2), 3 (SEQ ID NO:3), 6 (SEQ ID NO:6), 10 (SEQ ID NO:10), 11 (SEQ ID NO:1), 18 (SEQ ID NO:18), and 27 (SEQ ID NO:27)) do not activate transcription of the reporter gene.

FIG. 19 shows the results of the enhancer assay. The level of luciferase expression due to enhancement by the E47/E-box complex is set at 100 ("E47"). By comparison, none of the STAR elements bring about significant activation of luciferase expression. As expected, the scs and HS4 elements also do not bring about activation of the reporter gene. Therefore it is concluded that at least the tested STAR elements do not possess enhancer properties.

Example 19

Characterization of a Silencing Inducing Chromatin (SINC) Element

Materials and Methods

Figure 20:
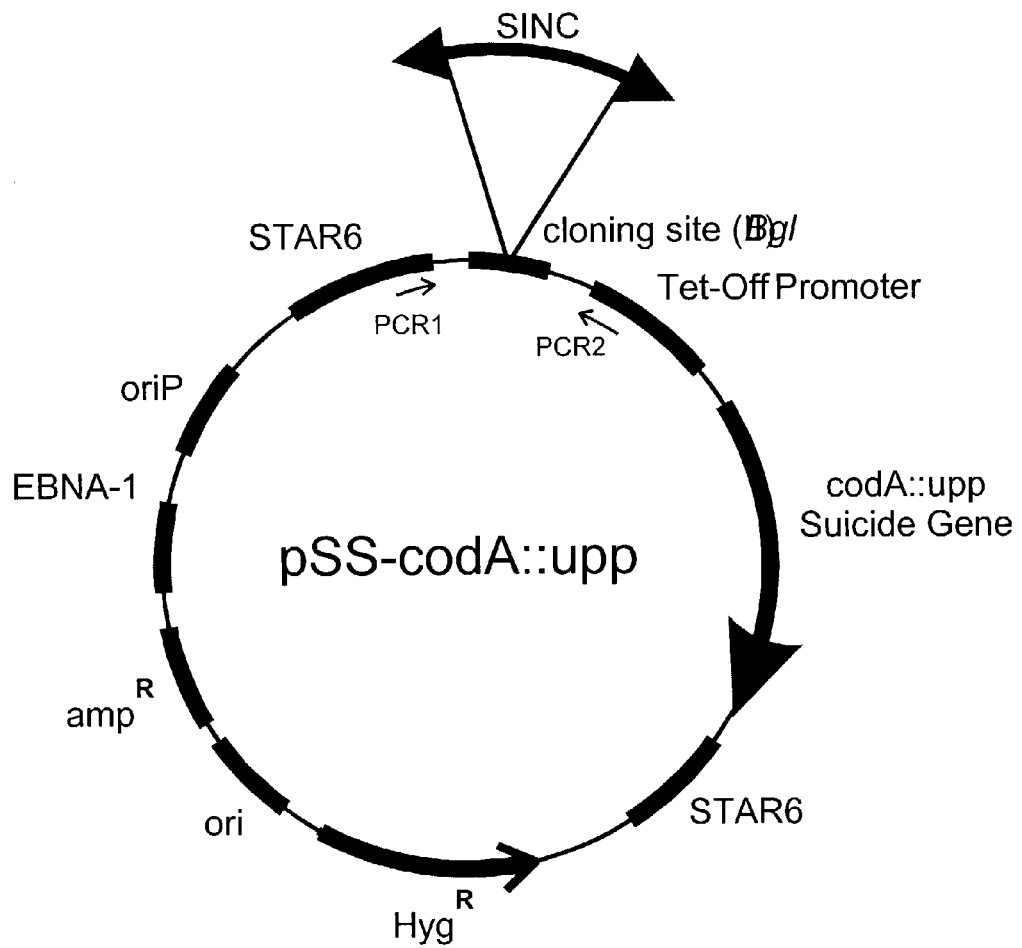
FIG. 20. The pSS-codA::upp vector used for isolation of SINC elements. The codA::upp suicide gene encodes a protein that converts the pro-drug 5-fluorocytosine to the toxic drug 5-fluorouracil. Upon induction by lowered doxycycline concentration, host cells become sensitive to the pro-drug. Genomic DNA fragments inserted at the BglII cloning site that have silencing activity will prevent expression of the suicide gene and allow formation of pro-drug resistant colonies. STAR elements flank the selection components to prevent spreading of silenced chromatin to the functional components of the plasmid. The plasmid is selected after transfection into mammalian cells with the hygromycin-resistance gene, and after transformation into *E. coli* with the ampicillin-resistance gene. It replicates episomally in cultured mammalian cells due to the oriP and EBNA-1 sequences, and in *E. coli* due to the ori sequence.

The general features of the SINC screen have been described in Example 1, and some aspects of it are recapitulated here. One version of the pSS vector used for screening SINC elements in genomic DNA is pSS-codA::upp (FIG. 20). It consists of the suicide gene expression unit, flanked by two STAR6 elements (SEQ ID NO:6). The expression unit, consisting of the codA::upp suicide gene under control of the Tet-Off promoter, is downstream of a BglII restriction site. A second version of the pSS vector, pSS-hrGFP (FIG. 21), was created by replacement of one STAR6 element (SEQ ID NO:6) with STAR8 (SEQ ID NO:8), and replacement of the suicide gene with the hrGFP gene, encoding green fluorescent protein (Stratagene 240059).

Human genomic DNA from chromosome 22 (Research Genetics 96010-22) was partially digested with Sau3AI and size fractionated. The 0.5–10 kilobase-pair fraction was ligated into the BglII site of pSS-codA::upp. This library represented ~20,000 independent clones with an average insert size of 1.2 kilobase pairs. The library was amplified in *Escherichia coli*. The purified DNA from the amplified library was transfected into U-2 OS/Tet-Off cells (van der Vlag et al., 2000) by standard techniques (calcium phosphate; Life Technologies 18306-019). A control transfection was carried out using empty pSS-codA::upp vector DNA, yielding 2400 hygromycin resistant colonies. Transfected cells were selected for hygromycin resistance (25 mg/ml) over a 3 week period at high doxycycline (10 ng/ml), and 1800 hygromycin-resistant colonies were recovered from the library transfection. These colonies were then incubated with the pro-drug 5-fluorocytosine (5-FC) at 1 mg/ml, with a boost of 5 mg/ml for 4 days, at a doxycycline concentration of 10 ng/ml. After 3 weeks all but 3 weakly-growing control colonies (transfected with empty pSS-codA::upp) had died; 58 of the library-transfected colonies survived. These colonies were allowed to recover from pro-drug treatment, and cultivated further. The 5-FC-resistant isolates were harvested, the cells were lysed, and a portion of the DNA was subjected to PCR amplification using primers D30 (SEQ ID NO:148) and D51 (SEQ ID NO:151) to recover the SINC elements. The PCR products from six 5-FC-resistant colonies were cloned between the HindIII and XhoI sites of pBluescript II SK(+) plasmid (Stratagene 212207) by conventional methods (Sambrook et al., 1989). The DNA sequences of the candidate SINC elements were determined as described (supra) using commercially available primers for the pBluescript vector (Stratagene 300301 and 300302). The sequences of these SINC elements are presented in Table 4B (SEQ ID NOs:135–140).

The 6 candidate SINC elements (SEQ ID NOs:135–140) were cloned into plasmid pSS-hrGFP in their native orientations, and the resulting plasmids were transfected into U-2 OS/Tet-Off cells. After selection for hygromycin resistance, the populations of pSS-hrGFP-SINC transfectants were cultivated further at a high doxycycline concentration (10 ng/ml). Total cellular RNA was extracted using the RNeasy Mini Kit (QIAGEN 74104) as described by the manufacturer. Northern blot analysis of GFP mRNA abundance in these populations was assessed using standard techniques (Sambrook et al., 1989). The GFP probe was a BamHI-EcoRI fragment encompassing base pairs 690 to 1419 in phrGFP-1. The blots were also probed for hygromycin mRNA as a control for PSS-hrGFP-derived plasmid copy number, and for beta-actin as a control for genomically-encoded mRNA quantity. The hygromycin probe was an SfuI-Sal I fragment extending from 8219-10144 in pREP4 (Invitrogen), and the beta-actin probe was from Clontech, #9800-1. After hybridization and washing, the blots were exposed to phosphorimager screens, and the radioactive signals were visualized and quantitated using a BioRad Personal F/X phosphorimager.

Results

Figure 21:
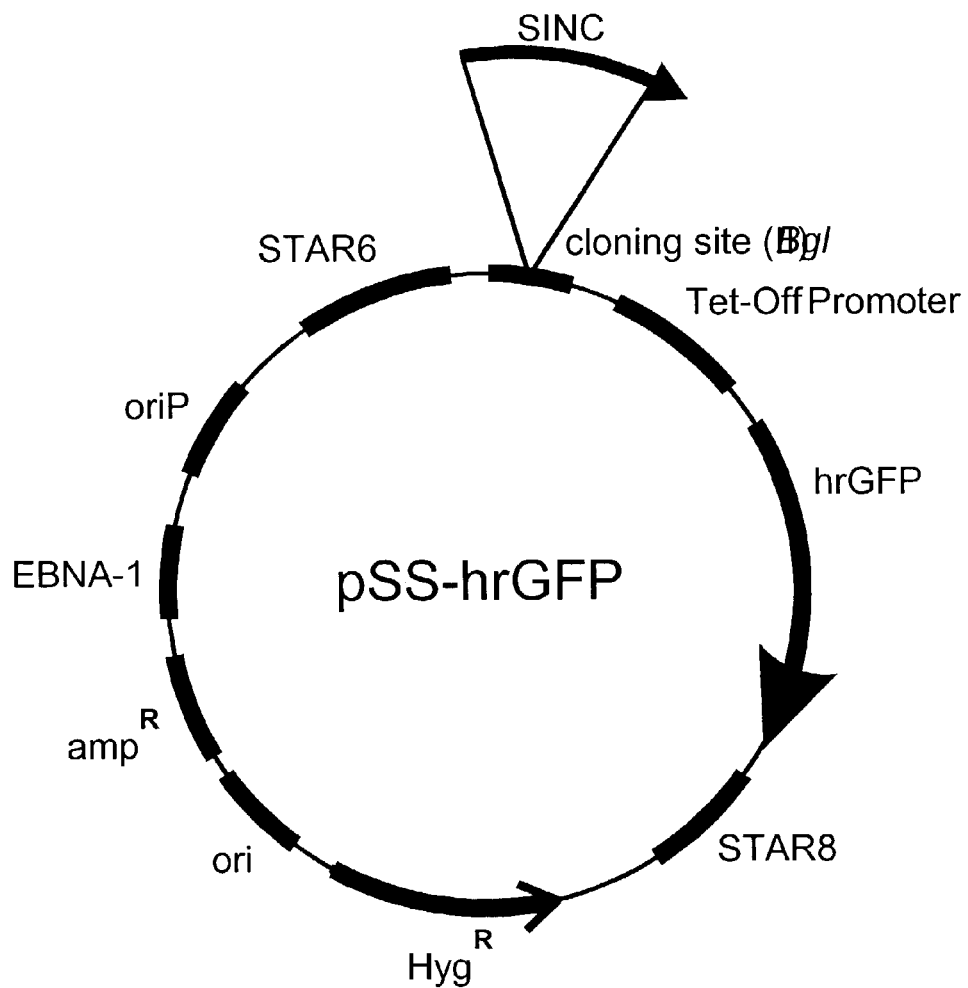
FIG. 21. The pSS-hrGFP plasmid is identical to the pSS-codA::upp plasmid, except for replacement of the suicide gene with hrGFP (encoding green fluorescent protein) and of STAR6 (SEQ ID NO:6) with STAR8 (SEQ ID NO:8) downstream of the GFP reporter gene.

SINC elements cloned adjacent to the GFP reporter gene will induce silencing of reporter gene transcription, but will not affect transcription of other genes. Accurate measurement of SINC activity takes advantage of this fact by determining the expression of GFP relative to the expression of two reference genes, rather than simply measuring absolute GFP expression. One reference gene is the hygromycin resistance gene on the pSS-hrGFP plasmid (outside the domain defined by the STAR elements; FIG. 21), and the other is the genomic beta-actin gene. SINC activity is quantified by RNA blot analysis as a reduction in the ratio of the GFP signal to the hygromycin and beta-actin signals. Among the candidate SINC elements that have been characterized, some display a significant relative reduction in GFP transcription, indicating that these DNAs are able to induce formation of silent chromatin. The SINC35 element (SEQ ID NO:140)(labelled PSINKS35 in Table 4B) has the strongest activity of these candidates. It brings about a 69% reduction in the GFP/hygromycin ratio, and a 75% reduction in the GFP/beta-actin signal. The strength of SINC activity in the other 5 candidates described in the original application, and in a number of other candidate SINC elements that have been isolated and characterized subsequent to submission of that application, is less. Therefore SINC35 (SEQ ID NO:140) has superior performance as a potent genetic element for induction of silent chromatin in diverse biotechnological applications.

Example 20

STAR Elements are Conserved Between Mouse and Human

BLAT analysis of the STAR DNA sequence against the human genome database (genome.ucsc.edu/cgi-bin/hgGateway) reveals that some of these sequences have high sequence conservation with other regions of the human genome. These duplicated regions are candidate STAR elements; if they do show STAR activity, they would be considered paralogs of the cloned STARs (two genes or genetic elements are the to be paralogous if they are derived from a duplication event (Li, 1997)).

BLAST analysis of the human STARs against the mouse genome (www.ensembl.org/Mus_musculus/blastview) also reveals regions of high sequence conservation between mouse and human. This sequence conservation has been shown for fragments of 15 out of the 65 human STAR elements. The conservation ranges from 64% to 89%, over lengths of 141 base pairs to 909 base pairs (Table 8). These degrees of sequence conservation are remarkable and suggest that these DNA sequences may confer STAR activity within the mouse genome as well. Some of the sequences from the mouse and human genomes in Table 8 could be strictly defined as orthologs (two genes or genetic elements are to be orthologous if they are derived from a speciation event (Li, 1997)). For example, STAR6 (SEQ ID NO:6) is between the SLC8A1 and HAAO genes in both the human and mouse genomes. In other cases, a cloned human STAR has a paralog within the human genome, and its ortholog has been identified in the mouse genome. For example, STAR3a is a fragment of the 15q11.2 region of human chromosome 15. This region is 96.9% identical (paralogous) with a DNA fragment at 5q33.3 on human chromosome 5, which is near the IL12B interleukin gene. These human DNAs share approximately 80% identity with a fragment of the 11B2 region on mouse chromosome 11. The 11B2 fragment is also near the (mouse) IL12B interleukin gene. Therefore STAR3a and the mouse 11B2 fragment can be strictly defined as paralogs.

In order to test the hypothesis that STAR activity is shared between regions of high sequence conservation in the mouse and human genome, one of the human STARs with a conserved sequence in mouse, STAR18 (SEQ ID NO:18), has been analyzed in greater detail. The sequence conservation in the mouse genome detected with the original STAR18 clone (SEQ ID NO:18) extends leftward on human chromosome 2 for about 500 base pairs (FIG. 22; left and right relate to the standard description of the arms of chromosome 2). In this example we examine whether the region of sequence conservation defines a "naturally occurring" STAR element in human that is more extensive in length than the original clone. We also examine whether the STAR function of this STAR element is conserved between mouse and human.

Materials and Methods

The region of mouse/human sequence conservation around STAR 18 (SEQ ID NO:18) was recovered from human BAC clone RP11-387A1 by PCR amplification, in three fragments: the entire region (primers E93 (SEQ ID NO:174) and E94 (SEQ ID NO:175)), the leftward half (primers E93 (SEQ ID NO:174) and E92 (SEQ ID NO:173)), and the rightward half (primers E57 (SEQ ID NO:172) and E94 (SEQ ID NO:175)). The corresponding fragments from the homologous mouse region were recovered from BAC clone RP23-400H17 in the same fashion (primers E95 (SEQ ID NO:176) and E98 (SEQ ID NO:178), E95 (SEQ ID NO:176) and E96 (SEQ ID NO:177), and E97 (SEQ ID NO:178) and E98 (SEQ ID NO:179), respectively). All fragments were cloned into the pSelect vector and transfected into a U-2 OS/Tet-Off/LexA-HP1 cell line (supra). Following transfection, hygromycin selection was carried out to select for transfected cells. The LexA-HP1 protein was induced by lowering the doxycycline concentration, and the ability of the transfected cells to withstand the antibiotic zeocin (a measure of STAR activity) was assessed by monitoring cell growth.

Results

Figure 22:
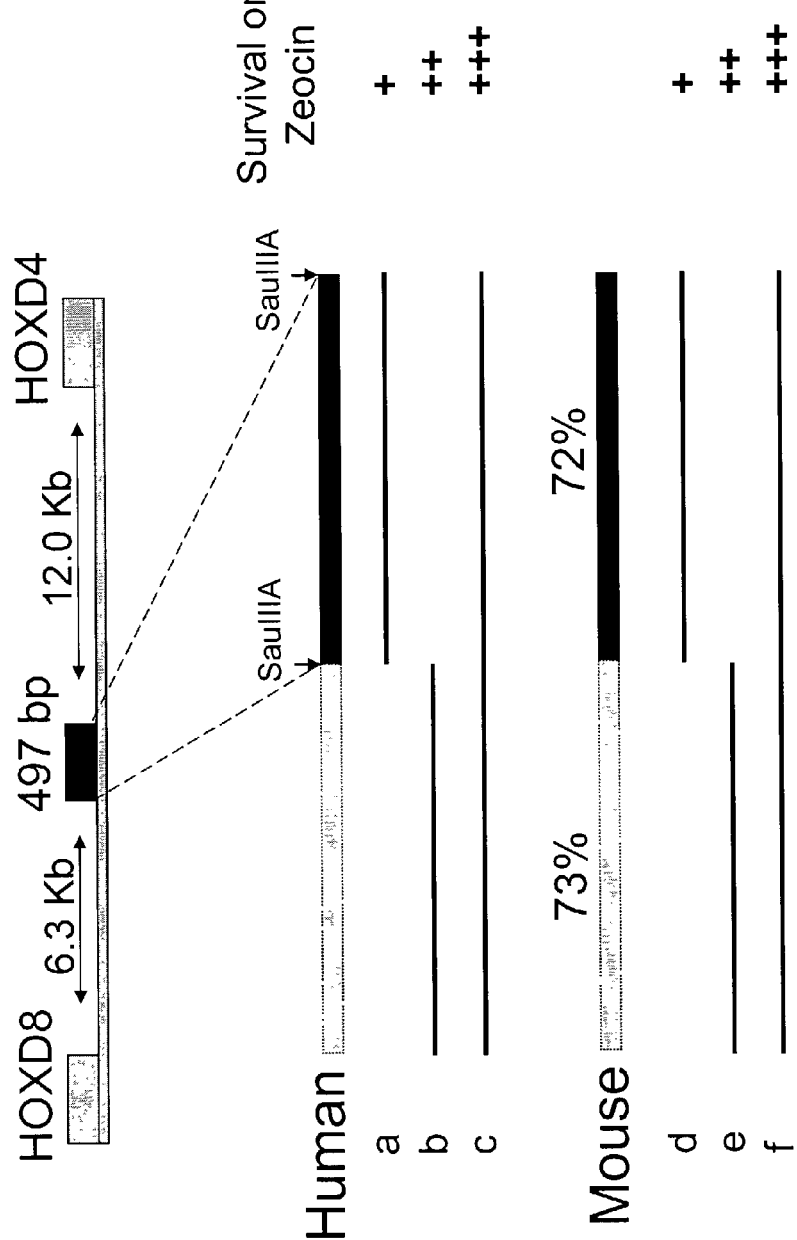
FIG. 22. STAR18 (SEQ ID NO:18) sequence conservation between mouse and human. The region of the human genome containing 497 base pair STAR18 (SEQ ID NO:18) is shown (black boxes); the element occurs between the HOXD8 and HOXD4 homeobox genes on human chromosome 2. It is aligned with a region in mouse chromosome 2 that shares 72% sequence identity. The region of human chromosome 2 immediately to the left of STAR18 (SEQ ID NO:18) is also highly conserved with mouse chromosome 2 (73% identity; gray boxes); beyond these region, the identity drops below 60%. The ability of these regions from human and mouse, either separately or in combination, to confer growth on zeocin is indicated: –, no growth; +, moderate growth; ++, vigorous growth; +++, rapid growth.

The original STAR18 clone (SEQ ID NO:18) was isolated from Sau3AI digested human DNA ligated into the pSelect vector on the basis of its ability to prevent silencing of a zeocin resistance gene. Alignment of the human STAR18 clone (SEQ ID NO:18) (497 base pairs) with the mouse genome revealed high sequence similarity (72%) between the orthologous human and mouse STAR18 regions (SEQ ID NO:18). It also uncovered high similarity (73%) in the region extending for 488 base pairs immediately leftwards of the Sau3AI site that defines the left end of the cloned region (FIG. 22). Outside these regions the sequence similarity between human and mouse DNA drops below 60%.

As indicated in FIG. 22, both the human and the mouse STAR18 elements (SEQ ID NO:18) confer survival on zeocin to host cells expressing the lexA-HP1 repressor protein. The original 497 base pair STAR18 clone (SEQ ID NO:18) and its mouse ortholog both confer the ability to grow (FIG. 22, a and d). The adjacent 488 base pair regions of high similarity from both genomes also confer the ability to grow, and in fact their growth phenotype is more vigorous than that of the original STAR18 clone (SEQ ID NO:18) (FIG. 22, b and e). When the entire region of sequence similarity was tested, these DNAs from both mouse and human confer growth, and the growth phenotype is more vigorous than the two sub-fragments (FIG. 22, c and f). These results demonstrate that the STAR activity of human STAR18 (SEQ ID NO:18) is conserved in its ortholog from mouse. The high sequence conservation between these orthologous regions is particularly noteworthy because they are not protein-coding sequences, leading to the conclusion that they have some regulatory function that has prevented their evolutionary divergence through mutation.

This analysis demonstrates that cloned STAR elements identified by the original screening program may in some cases represent partial STAR elements, and that analysis of the genomic DNA in which they are embedded can identify sequences with stronger STAR activity.

Example 21

STAR Elements Contain Characteristic DNA Sequence Motifs

STAR elements are isolated on the basis of their anti-repression phenotype with respect to transgene expression. This anti-repression phenotype reflects underlying biochemical processes that regulate chromatin formation which are associated with the STAR elements. These processes are typically sequence-specific and result from protein binding or DNA structure. This suggests that STAR elements will share DNA sequence similarity. Identification of sequence similarity among STAR elements will provide sequence motifs that are characteristic of the elements that have already been identified by functional screens and tests. The sequence motifs will also be useful to recognize and claim new STAR elements whose functions conform to the claims of this patent. The functions include improved yield and stability of transgenes expressed in eukaryotic host cells.

Other benefits of identifying sequence motifs that characterize STAR elements include: (1) provision of search motifs for prediction and identification of new STAR elements in genome databases, (2) provision of a rationale for modification of the elements, and (3) provision of information for functional analysis of STAR activity. Using bioinformatics, sequence similarities among STAR elements have been identified; the results are presented in this example.

Bioinformatic and Statistical Background. Regulatory DNA elements typically function via interaction with sequence-specific DNA-binding proteins. Bio-informatic analysis of DNA elements such as STAR elements whose regulatory properties have been identified, but whose interacting proteins are unknown, requires a statistical approach for identification of sequence motifs. This can be achieved by a method that detects short DNA sequence patterns that are over-represented in a set of regulatory DNA elements (e.g., the STAR elements) compared to a reference sequence (e.g., the complete human genome). The method determines the number of observed and expected occurrences of the patterns in each regulatory element. The number of expected occurrences is calculated from the number of observed occurrences of each pattern in the reference sequence.

The DNA sequence patterns can be oligonucleotides of a given length, e.g., six base pairs. In the simplest analysis, for a 6 base pair oligonucleotide (hexamer) composed of the four nucleotides (A, C, G, and T) there are $4^6=4096$ distinct oligonucleotides (all combinations from AAAAAA (SEQ ID NO:122) to TTTTTT (SEQ ID NO:123)). If the regulatory and reference sequences were completely random and had equal proportions of the A, C, G, and T nucleotides, then the expected frequency of each hexamer would be 1/4096 (~0.00024). However, the actual frequency of each hexamer in the reference sequence is typically different than this due to biases in the content of G:C base pairs, etc. Therefore the frequency of each oligonucleotide in the reference sequence is determined empirically by counting, to create a "frequency table" for the patterns.

The pattern frequency table of the reference sequence is then used to calculate the expected frequency of occurrence of each pattern in the regulatory element set. The expected frequencies are compared with the observed frequencies of occurrence of the patterns. Patterns that are "over-represented" in the set are identified; for example, if the hexamer ACGTGA (SEQ ID NO:124) is expected to occur 5 times in 20 kilobase pairs of sequence, but is observed to occur 15 times, then it is three-fold over-represented. Ten of the 15 occurrences of that hexameric sequence pattern would not be expected in the regulatory elements if the elements had the same hexamer composition as the entire genome. Once the over-represented patterns are identified, a statistical test is applied to determine whether their over-representation is significant, or may be due to chance. For this test, a significance index, "sig", is calculated for each pattern. The significance index is derived from the probability of occurrence of each pattern, which is estimated by a binomial distribution. The probability takes into account the number of possible patterns (4096 for hexamers). The highest sig values correspond to the most overrepresented oligonucleotides (van Helden et al., 1998). In practical terms, oligonucleotides with sig>=0 are considered as over-represented. A pattern with sig>=0 is likely to be over-represented due to chance once (=$10^0$) in the set of regulatory element sequences. However, at sig>=1 a pattern is expected to be over-represented once in ten (=$10^1$) sequence sets, sig>=2 once in 100 (=$10^2$) sequence sets, etc.

The patterns that are significantly over-represented in the regulatory element set are used to develop a model for classification and prediction of regulatory element sequences. This employs Discriminant Analysis, a so-called "supervised" method of statistical classification known to one of ordinary skill in the art (Huberty, 1994). In Discriminant Analysis, sets of known or classified items (e.g., STAR elements) are used to "train" a model to recognize those items on the basis of specific variables (e.g., sequence patterns such as hexamers). The trained model is then used to predict whether other items should be classified as belonging to the set of known items (e.g., is a DNA sequence a STAR element). In this example, the known items in the training set are STAR elements (positive training set). They are contrasted with sequences that are randomly selected from the genome (negative training set) which have the same length as the STAR elements. Discriminant Analysis establishes criteria for discriminating positives from negatives based on a set of variables that distinguish the positives; in this example, the variables are the significantly over-represented patterns (e.g., hexamers).

When the number of over-represented patterns is high compared to the size of the training set, the model could become biased due to over-training. Over-training is circumvented by applying a forward stepwise selection of variables (Huberty, 1994). The goal of Stepwise Discriminant Analysis is to select the minimum number of variables that provides maximum discrimination between the positives and negatives. The model is trained by evaluating variables one-by-one for their ability to properly classify the items in the positive and negative training sets. This is done until addition of new variables to the model does not significantly increase the model's predictive power (i.e. until the classification error rate is minimized). This optimized model is then used for testing, in order to predict whether "new" items are positives or negatives (Huberty, 1994).

It is inherent in classification statistics that for complex items such as DNA sequences, some elements of the positive training set will be classified as negatives (false negatives), and some members of the negative training set will be classified as positives (false positives). When a trained model is applied to testing new items, the same types of misclassifications are expected to occur.

In the bioinformatic method described here, the first step, pattern frequency analysis, reduces a large set of sequence patterns (e.g., all 4096 hexamers) to a smaller set of significantly over-represented patterns (e.g., 100 hexamers); in the second step, Stepwise Discriminant Analysis reduces the set of over-represented patterns to the subset of those patterns that have maximal discriminative power (e.g., 5–10 hexamers). Therefore this approach provides simple and robust criteria for identifying regulatory DNA elements such as STAR elements.

DNA-binding proteins can be distinguished on the basis of the type of binding site they occupy. Some recognize contiguous sequences; for this type of protein, patterns that are oligonucleotides of length 6 base pairs (hexamers) are fruitful for bio-informatic analysis (van Helden et al., 1998). Other proteins bind to sequence dyads: contact is made between pairs of highly conserved trinucleotides separated by a non-conserved region of fixed width (van Helden et al., 2000). In order to identify sequences in STAR elements that may be bound by dyad-binding proteins, frequency analysis was also conducted for this type of pattern, where the spacing between the two trinucleotides was varied from 0 to 20 (i.e., XXXN{0-20}XXX where X's are specific nucleotides composing the trinucleotides, and N's are random nucleotides from 0 to 20 base pairs in length). The results of dyad frequency analysis are also used for Linear Discriminant Analysis as described above.

Materials and Methods

Using the genetic screen described in the original patent application, sixty-six (66) STAR elements were initially isolated from human genomic DNA and characterized in detail (Table 6). The screen was performed on gene libraries constructed by Sau3AI digestion of human genomic DNA, either purified from placenta (Clontech 6550-1) or carried in bacterial/P1 (BAC/PAC) artificial chromosomes. The BAC/PAC clones contain genomic DNA from regions of chromosome 1 (clones RP1154H19 and RP3328E19), from the HOX cluster of homeotic genes (clones RP1167F23, RP1170019, and RP11387A1), or from human chromosome 22 (Research Genetics 96010-22). The DNAs were size-fractionated, and the 0.5–2 kb size fraction was ligated into BamHI-digested pSelect vector, by standard techniques (Sambrook et al., 1989). pSelect plasmids containing human genomic DNA that conferred resistance to zeocin at low doxycycline concentrations were isolated and propagated in *Escherichia coli*. The screens that yielded the STAR elements of Table 6 have assayed approximately 1–2% of the human genome.

The human genomic DNA inserts in these 66 plasmids were sequenced by the dideoxy method (Sanger et al., 1977) using a Beckman CEQ2000 automated DNA sequencer, using the manufacturer's instructions. Briefly, DNA was purified from *E. coli* using QIAprep Spin Miniprep and Plasmid Midi Kits (QIAGEN 27106 and 12145, respectively). Cycle sequencing was carried out using custom oligonucleotides corresponding to the pSelect vector (primers D89 (SEQ ID NO:152) and D95 (SEQ ID NO:157), Table 5), in the presence of dye terminators (CEQ Dye Terminator Cycle Sequencing Kit, Beckman 608000). Assembled STAR DNA sequences were located in the human genome (database builds August and December 2001) using BLAT (Basic Local Alignment Tool (Kent, 2002); genome.ucsc.edu/cgi-bin/hgGateway; Table 6). In aggregate, the combined STAR sequences comprise 85.6 kilobase pairs, with an average length of 1.3 kilobase pairs.

Figure 23:
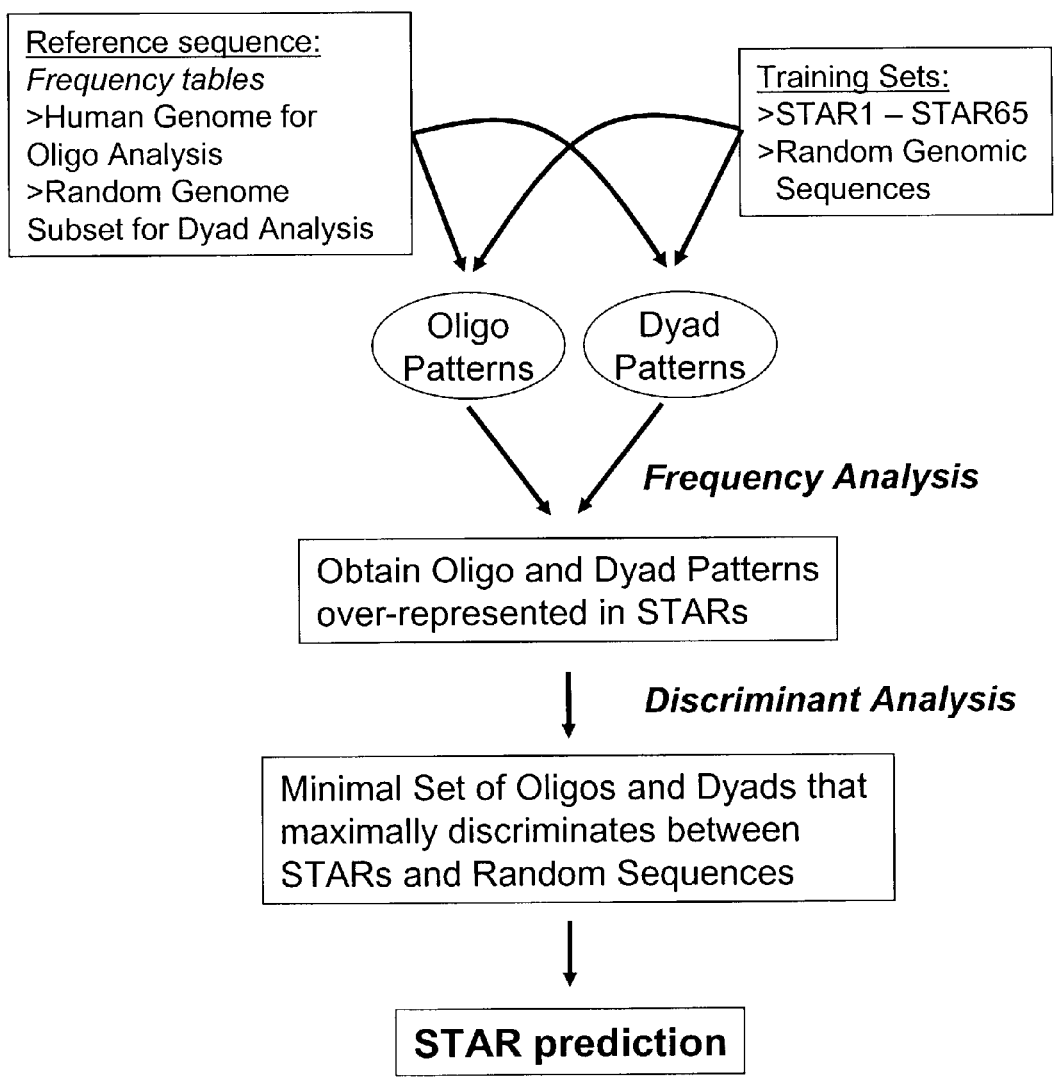
FIG. 23. Schematic diagram of bio-informatic analysis workflow. For details, see text.

Sequence motifs that distinguish STAR elements within human genomic DNA were identified by bio-informatic analysis using a two-step procedure, as follows (see, FIG. 23 for a schematic diagram). The analysis has two input datasets: (1) the DNA sequences of the STAR elements (STAR1–STAR65 (SEQ ID NOs:1–65) were used; Table 6); and (2) the DNA sequence of the human genome (except for chromosome 1, which was not feasible to include due to its large size; for dyad analysis a random subset of human genomic DNA sequence (~27 Mb) was used).

Pattern Frequency Analysis. The first step in the analysis uses RSA-Tools software (Regulatory Sequence Analysis Tools; www.ucmb.ulb.ac.be/bioinformatics/rsa-tools/; references (van Helden et al., 1998, van Helden et al., 2000, van Helden et al., 2000)) to determine the following information: (1) the frequencies of all dyads and hexameric oligonucleotides in the human genome; (2) the frequencies of the oligonucleotides and dyads in the 65 STAR elements; and (3) the significance indices of those oligonucleotides and dyads that are over-represented in the STAR elements compared to the genome. A control analysis was done with 65 sequences that were selected at random from the human genome (i.e. from 2689×10^3 kilobase pairs) that match the length of the STAR elements of Table 6.

Discriminant Analysis. The over-represented oligonucleotides and dyads were used to train models for prediction of STAR elements by Linear Discriminant Analysis (Huberty, 1994). A pre-selection of variables was performed by selecting the 50 patterns with the highest individual discriminatory power from the over-represented oligos or dyads of the frequency analyses. These pre-selected variables were then used for model training in a Stepwise Linear Discriminant Analysis to select the most discriminant combination of variables (Huberty, 1994). Variable selection was based on minimizing the classification error rate (percentage of false negative classifications). In addition, the expected error rate was estimated by applying the same discriminant approach to the control set of random sequences (minimizing the percentage of false positive classifications).

The predictive models from the training phase of Discriminant Analysis were tested in two ways. First, the STAR elements and random sequences that were used to generate the model (the training sets) were classified. Second, sequences in a collection of 19 candidate STAR elements (recently cloned by zeocin selection as described above) were classified. These candidate STAR elements are listed in Table 11 (SEQ ID:66–84).

Results

Pattern frequency analysis was performed with RSA-Tools on 65 STAR elements, using the human genome as the reference sequence. One hundred sixty-six (166) hexameric oligonucleotides were found to be over-represented in the set of STAR elements (sig>=0) compared to the entire genome (Table 9). The most significantly over-represented oligonucleotide, CCCCAC (SEQ ID NO:184), occurs 107 times among the 65 STAR elements, but is expected to occur only 49 times. It has a significance coefficient of 8.76; in other words, the probability that its over-representation is due to random chance is $1/10^{8.76}$, i.e., less than one in 500 million.

Ninety-five of the oligonucleotides have a significance coefficient greater than 1, and are therefore highly over-represented in the STAR elements. Among the over-represented oligonucleotides, their observed and expected occurrences, respectively, range from 6 and 1 (for oligo 163, CGCGAA (SEQ ID NO:346), sig=0.02) to 133 and 95 (for oligo 120, CCCAGG (SEQ ID NO:303), sig=0.49). The differences in expected occurrences reflect factors such as the G:C content of the human genome. Therefore the differences among the oligonucleotides in their number of occurrences is less important than their over-representation; for example, oligo 2 (CAGCGG (SEQ ID NO:185)) is 36/9=4-fold over-represented, which has a probability of being due to random chance of one in fifty million (sig=7.75).

Table 9 also presents the number of STAR elements in which each over-represented oligonucleotide is found. For example, the most significant oligonucleotide, oligo 1 (CCCCAC (SEQ ID NO:184)), occurs 107 times, but is found in only 51 STARs, i.e. on average it occurs as two copies per STAR. The least abundant oligonucleotide, number 166 (AATCGG (SEQ ID NO:349)), occurs on average as a single copy per STAR (thirteen occurrences on eleven STARs); single-copy oligonucleotides occur frequently, especially for the lower-abundance oligos. At the other extreme, oligo 4 (CAGCCC (SEQ ID NO:187)) occurs on average 3 times in those STARs in which it is found (37 STARs). The most widespread oligonucleotide is number 120 (CCCAGG (SEQ ID NO:303)), which occurs on 58

STARs (on average twice per STAR), and the least widespread oligonucleotide is number 114 (CGTCGC (SEQ ID NO:297)), which occurs on only 6 STARs (and on average only once per STAR).

Results of dyad frequency analysis are given in Table 10. Seven hundred thirty (730) dyads were found to be over-represented in the set of STAR elements (sig>=0) compared to the reference sequence. The most significantly over-represented dyad, CCCN{2}CGG (SEQ ID NO:36), occurs 36 times among the 65 STAR elements, but is expected to occur only 7 times. It has a significance coefficient of 9.31; in other words, the probability that its over-representation is due to chance is ⅒^9.31, i.e. less than one in 2 billion.

Three hundred ninety-seven of the dyads have a significance coefficient greater than 1, and are therefore highly over-represented in the STAR elements. Among the over-represented dyads, their observed and expected occurrences, respectively, range from 9 and 1 (for five dyads (numbers 380 (SEQ ID NO:729), 435 (SEQ ID NO:784), 493 (SEQ ID NO:842), 640 (SEQ ID NO:989), and 665 (SEQ ID NO:1014)) to 118 and 63 (for number 30 (AGGN{2}GGG) (SEQ ID NO:379), sig=4.44).

The oligonucleotides and dyads found to be over-represented in STAR elements by pattern frequency analysis were tested for their discriminative power by Linear Discriminant Analysis. Discriminant models were trained by step-wise selection of the best combination among the 50 most discriminant oligonucleotide (Table 9) or dyad (Table 10) patterns. The models achieved optimal error rates after incorporation of 4 (dyad) or 5 variables. The discriminative variables from oligo analysis are numbers 11 (SEQ ID NO:194), 30 (SEQ ID NO:213), 94 (SEQ ID NO:277), 122 (SEQ ID NO:305), and 160 (SEQ ID NO:343)(Tables 9); those from dyad analysis are numbers 73 (SEQ ID NO:422), 194 (SEQ ID NO:543), 419 (SEQ ID NO:768), and 497 (SEQ ID NO:846)(Table 10).

Figure 24:
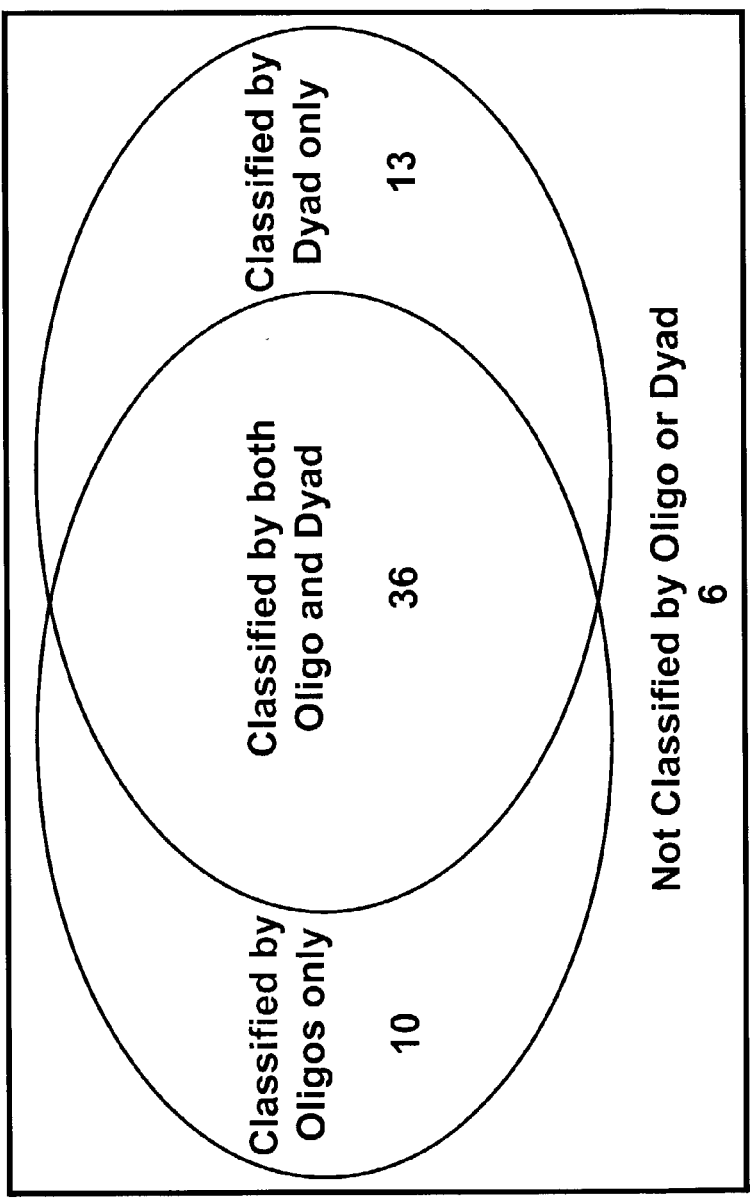
FIG. 24. Results of discriminant analysis on classification of the training set of 65 STAR elements. STAR elements that are correctly classified as STARs by Stepwise Linear Discriminant Analysis (LDA) are shown in a Venn diagram. The variables for LDA were selected from frequency analysis results for hexameric oligonucleotides ("oligos") and for dyads. The diagram indicates the concordance of the two sets of variables in correctly classifying STARs.

The discriminant models were then used to classify the 65 STAR elements in the training set and their associated random sequences. The model using oligonucleotide variables classifies 46 of the 65 STAR elements as STAR elements (true positives); the dyad model classifies 49 of the STAR elements as true positives. In combination, the models classify 59 of the 65 STAR elements as STAR elements (91%; FIG. 24). The false positive rates (random sequences classified as STARs) were 7 for the dyad model, 8 for the oligonucleotide model, and 13 for the combined predictions of the two models (20%). The STAR elements of Table 6 that were not classified as STARs by LDA are STARs 7 (SEQ ID NO:7), 22 (SEQ ID NO:22), 35 (SEQ ID NO:35), 44 (SEQ ID NO:44), 46 (SEQ ID NO:46), and 65 (SEQ ID NO:65). These elements display stabilizing anti-repressor activity in functional assays, so the fact that they are not classified as STARs by LDA suggests that they represent another class (or classes) of STAR elements.

The models were then used to classify the 19 candidate STAR elements in the testing set listed in Table 11. The dyad model classifies 12 of these candidate STARs as STAR elements, and the oligonucleotide model classifies 14 as STARs. The combined number of the candidates that are classified as STAR elements is 15 (79%). This is a lower rate of classification than obtained with the training set of 65 STARs; this is expected for two reasons. First, the discriminant models were trained with the 65 STARs of Table 6, and discriminative variables based on this training set may be less well represented in the testing set. Second, the candidate STAR sequences in the testing set have not yet been fully characterized in terms of in vivo function, and may include elements with only weak anti-repression properties.

This analysis demonstrates the power of a statistical approach to bio-informatic classification of STAR elements. The STAR sequences contain a number of dyad and hexameric oligonucleotide patterns that are significantly over-represented in comparison with the human genome as a whole. These patterns may represent binding sites for proteins that confer STAR activity; in any case they form a set of sequence motifs that can be used to recognize STAR element sequences.

Using these patterns to recognize STAR elements by Discriminant Analysis, a high proportion of the elements obtained by the genetic screen of the invention are in fact classified as STARs. This reflects underlying sequence and functional similarities among these elements. An important aspect of the method described here (pattern frequency analysis followed by Discriminant Analysis) is that it can be reiterated; for example, by including the 19 candidate STAR elements of Table 11 (SEQ ID NOs:66–84) with the 66 STAR elements (SEQ ID Nos:1–66) of Table 6 into one training set, an improved discriminant model can be trained. This improved model can then be used to classify other candidate regulatory elements as STARS. Large-scale in vivo screening of genomic sequences using the method of the invention, combined with reiteration of the bio-informatic analysis, will provide a means of discriminating STAR elements that asymptotically approaches 100% recognition and prediction of elements as the genome is screened in its entirety. These stringent and comprehensive predictions of STAR function will ensure that all human STAR elements are recognized, and are available for use in improving transgene expression.

Example 22

Cloning and Characterization of STAR Elements from *Arabidopsis thaliana*

Transgene silencing occurs in transgenic plants at both the transcriptional and post-transcriptional levels (Meyer, 2000, Vance & Vaucheret, 2001). In either case, the desired result of transgene expression can be compromised by silencing; the low expression and instability of the transgene results in poor expression of desirable traits (e.g., pest resistance) or low yields of recombinant proteins. It also results in poor predictability: the proportion of transgenic plants that express the transgene at biotechnologically useful levels is low, which necessitates laborious and expensive screening of transformed individuals for those with beneficial expression characteristics. This example describes the isolation of STAR elements from the genome of the dicot plant *Arabidopsis thaliana* for use in preventing transcriptional transgene silencing in transgenic plants. *Arabidopsis* was chosen for this example because it is a well-studied model organism: it has a compact genome, it is amenable to genetic and recombinant DNA manipulations, and its genome has been sequenced (Bevan et al., 2001, Initiative, 2000, Meinke et al., 1998).

Materials and Methods:

Genomic DNA was isolated from *Arabidopsis thaliana* ecotype Columbia as described (Stam et al., 1998) and partially digested with MboI. The digested DNA was size-fractionated to 0.5–2 kilobase pairs by agarose gel electrophoresis and purification from the gel (QIAquick Gel Extraction Kit, QIAGEN 28706), followed by ligation into the pSelect vector (supra). Transfection into the U-2 OS/Tet-Off/LexA-HP1 cell line and selection for zeocin resistance at low doxycycline concentration was performed as described (supra). Plasmids were isolated from zeocin resistant colonies and re-transfected into the U-2 OS/Tet-Off/LexA-HP1 cell line.

Sequencing of *Arabidopsis* genomic DNA fragments that conferred zeocin resistance upon re-transfection was performed as described (supra). The DNA sequences were compared to the sequence of the *Arabidopsis* genome by BLAST analysis ((Altschul et al., 1990); www.ncbi.nlm.nih.gov/blast/Blast).

STAR activity was tested further by measuring mRNA levels for the hygromycin- and zeocin-resistance genes in recombinant host cells by reverse transcription PCR (RT-PCR). Cells of the U-2 OS/Tet-Off/lexA-HP1 cell line were transfected with pSelect plasmids containing *Arabidopsis* STAR elements, the *Drosophila* scs element, or containing no insert (supra). These were cultivated on hygromycin for 2 weeks at high doxycycline concentration, then the doxycycline concentration was lowered to 0.1 ng/ml to induce the lexA-HP1 repressor protein. After 10 days, total RNA was isolated by the RNeasy mini kit (QIAGEN 74104) as described by the manufacturer. First-strand cDNA synthesis was carried out using the RevertAid First Strand cDNA Synthesis kit (MBI Fermentas 1622) using oligo(dT)18 primer as described by the manufacturer. An aliquot of the cDNA was used as the template in a PCR reaction using primers D58 (SEQ ID NO:180) and D80 (SEQ ID NO:181) (for the zeocin marker), and D70 (SEQ ID NO:182) and D71 (SEQ ID NO:183)(for the hygromycin marker), and Taq DNA polymerase (Promega M2661). The reaction conditions were 15–20 cycles of 94C for 1 minute, 54C for 1 minute, and 72C for 90 seconds. These conditions result in a linear relationship between input RNA and PCR product DNA. The PCR products were resolved by agarose gel electrophoresis, and the zeocin and hygromycin bands were detected by Southern blotting as described (Sambrook et al., 1989), using PCR products produced as above with purified pSelect plasmid as template. The ratio of the zeocin and hygromycin signals corresponds to the normalized expression level of the zeocin gene.

Results

The library of *Arabidopsis* genomic DNA in the pSelect vector comprised 69,000 primary clones in *E. coli*, 80% of which carried inserts. The average insert size was approximately 1000 base pairs; the library therefore represents approximately 40% of the *Arabidopsis* genome.

A portion of this library (representing approximately 16% of the *Arabidopsis* genome) was transfected into the U-2 OS/Tet-Off/LexA-HP1 cell line. Hygromycin selection was imposed to isolate transfectants, which resulted in 27,000 surviving colonies. These were then subjected to zeocin selection at low doxycycline concentration. Putative STAR-containing plasmids from 56 zeocin-resistant colonies were rescued into *E. coli* and re-transfected into U-2 OS/Tet-Off/LexA-HP1 cells. Forty-four of these plasmids (79% of the plasmids tested) conferred zeocin resistance on the host cells at low doxycycline concentrations, demonstrating that the plasmids carried STAR elements. This indicates that the pSelect screen in human U-2 OS cells is highly efficient at detection of STAR elements from plant genomic DNA.

The DNA sequences of these 44 candidate STAR elements were determined. Thirty-five of them were identified as single loci in the database of *Arabidopsis* nuclear genomic sequence (Table 12; SEQ ID NOs:85–119). Four others were identified as coming from the chloroplast genome, four were chimeras of DNA fragments from two loci, and one was not found in the *Arabidopsis* genome database.

The strength of the cloned *Arabidopsis* STAR elements was tested by assessing their ability to prevent transcriptional repression of the zeocin-resistance gene, using an RT-PCR assay. As a control for RNA input among the samples, the transcript levels of the hygromycin-resistance gene for each STAR transfection were assessed too. This analysis has been performed for 12 of the *Arabidopsis* STAR elements. The results (FIG. 25) demonstrate that the *Arabidopsis* STAR elements are superior to the *Drosophila* scs element (positive control) and the empty vector ("SV40"; negative control) in their ability to protect the zeocin-resistance gene from transcriptional repression. In particular, STAR-A28 (SEQ ID NO:112) and STAR-A30 (SEQ ID NO:114) enable 2-fold higher levels of zeocin-resistance gene expression than the scs element (normalized to the internal control of hygromycin-resistance gene mRNA) when the lexA-HP1 repressor is expressed.

These results demonstrate that the method of the invention can be successfully applied to recovery of STAR elements from genomes of other species than human. Its successful application to STAR elements from a plant genome is particularly significant because it demonstrates the wide taxonomic range over which the method of the invention is applicable, and because plants are an important target of biotechnological development.

REFERENCES

Altschul, S. F. and Gish, W. (1996) Local alignment statistics. Methods Enzymol, 266, 460–480.

Altschul, S. F., Gish, W., Miller, W., Myers, E. W. and Lipman, D. J. (1990) Basic local alignment search tool. J Mol Biol, 215, 403–410.

Bell, A C, West, A G, and Felsenfeld, G. (2001) Insulators and boundaries: versatile regulatory elements in the eukaryotic genome Science 291, 447–50.

Bennett, R. P., Cox, C. A. and Hoeffler, J. P. (1998) Fusion of green fluorescent protein with the Zeocin-resistance marker allows visual screening and drug selection of transfected eukaryotic cells. Biotechniques, 24, 478–482.

Berger, J, Hauber, J, Hauber, R, Geiger, R, and Cullen, B R. (1988) Secreted placental alkaline phosphatase: a powerful new quantitative indicator of gene expression in eukaryotic cells Gene 66, 1–10.

Bevan, M, Mayer, K, White, O, Eisen, J A, Preuss, D, Bureau, T, Salzberg, S L, and Mewes, H W. (2001) Sequence and analysis of the *Arabidopsis* genome Curr Opin Plant Biol 4, 105–10.

Bierhuizen, M. F., Westerman, Y., Visser, T. P., Wognum, A. W. and Wagemaker, G. (1997) Green fluorescent protein variants as markers of retroviral-mediated gene transfer in primary hematopoietic cells and cell lines. Biochem Biophys Res Commun, 234, 371–375.

Boivin, A, and Dura, J M. (1998) In vivo chromatin accessibility correlates with gene silencing in *Drosophila* Genetics 150, 1539–49.

Boshart, M, Weber, F, Jahn, G, Dorsch-Hasler, K, Fleckenstein, B, and Schaffner, W. (1985) A very strong enhancer is located upstream of an immediate early gene of human cytomegalovirus Cell 41, 521–30.

Breckenridge, D. G. and Shore, G. C. (2000) Regulation of apoptosis by E1A and Myc oncoproteins. Crit Rev Eukaryot Gene Expr 10, 273–280.

Bunker, C. A. and Kingston, R. E. (1994) Transcriptional repression by *Drosophila* and mammalian Polycomb group proteins in transfected mammalian cells. Mol Cell Biol, 14, 1721–1732.

Cherry, J. R., Lamsa, M. H., Schneider, P., Vind, J., Svendsen, A., Jones, A. and Pedersen, A. H. (1999) Directed evolution of a fungal peroxidase. Nat Biotechnol, 17, 379–384.

Chung, J H, Whiteley, M, and Felsenfeld, G. (1993) A 5' element of the chicken beta-globin domain serves as an insulator in human erythroid cells and protects against position effect in *Drosophila* Cell 74, 505–14.

Deuschle, U, Meyer, WK, and Thiesen, H J. (1995) Tetracycline-reversible silencing of eukaryotic promoters Mol Cell Biol 15, 1907–14.

Doll, R. F., Crandall, J. E., Dyer, C. A., Aucoin, J. M. and Smith, F. I. (1996) Comparison of promoter strengths on gene delivery into mammalian brain cells using AAV vectors. Gene Ther, 3, 437–447.

Eissenberg, J. C., James T. C., Foster-Hartnett D. M., Hartnett T., Ngan V., and Elgin S. C. R. (1990) Mutation in a heterochromatin-specific chromosomal protein is associated with suppression of position-effect variegation in *Drosophila melanogaster*. Proc Natl Acad Sci (USA) 87: 9923–9927.

Feng, Y. Q., Seibler, J., Alami, R., Eisen, A., Westerman, K. A., Leboulch, P., Fiering, S. and Bouhassira, E. E. (1999) Site-specific chromosomal integration in mammalian cells: highly efficient CRE recombinase-mediated cassette exchange. J Mol Biol, 292, 779–785.

Foecking, M K, and Hofstetter, H. (1986) Powerful and versatile enhancer-promoter unit for mammalian expression vectors Gene 45, 101–5.

Garrick, D, Fiering, S, Martin, D I, and Whitelaw, E. (1998) Repeat-induced gene silencing in mammals Nat Genet 18, 56–9.

Gaszner, M., Vazquez, J. and Schedl, P. (1999) The Zw5 protein, a component of the scs chromatin domain boundary, is able to block enhancer-promoter interaction. Genes Dev, 13, 2098–2107.

Gerasimova, T. I. and Corces, V. G. (1998) Polycomb and trithorax group proteins mediate the function of a chromatin insulator. Cell, 92, 511–521.

Gerasimova, T I, and Corces, V G. (2001) Chromatin insulators and boundaries: effects on transcription and nuclear organization Annu Rev Genet 35, 193–208.

Gossen, M. and Bujard, H. (1992) Tight control of gene expression in mammalian cells by tetracycline-responsive promoters. Proc Natl Acad Sci USA, 89, 5547–5551.

Graham, F. L. and van der Eb, A. J. (1973) Transformation of rat cells by DNA of human adenovirus 5. Virology, 54, 536–539.

Heldin, C. H., Johnsson, A., Wennergren, S., Wernstedt, C., Betsholtz, C. and Westermark, B. (1986) A human osteosarcoma cell line secretes a growth factor structurally related to a homodimer of PDGF A-chains. Nature, 319, 511–514.

Henke, E. and Bornscheuer, U. T. (1999) Directed evolution of an esterase from *Pseudomonas fluorescens*. Random mutagenesis by error-prone PCR or a mutator strain and identification of mutants showing enhanced enantioselectivity by a resorufin-based fluorescence assay. Biol Chem, 380, 1029–1033.

Henthorn, P, Zervos, P, Raducha, M, Harris, H, and Kadesch, T. (1988) Expression of a human placental alkaline phosphatase gene in transfected cells: use as a reporter for studies of gene expression Proc Natl Acad Sci USA 85, 6342–6.

Higgins, D. G., Thompson, J. D. and Gibson, T. J. (1996) Using CLUSTAL for multiple sequence alignments. Methods Enzymol, 266, 383–402.

Himes, S. R. and Shannon, M. F. (2000) Assays for transcriptional activity based on the luciferase reporter gene. Methods Mol Biol, 130, 165–174.

Huberty, C J (1994) Applied discriminant analysis, Wiley and Sons, New York.

Initiative, A G. (2000) Analysis of the genome sequence of the flowering plant *Arabidopsis thaliana* Nature 408, 796–815.

Izumi, M, and Gilbert, DM. (1999) Homogeneous tetracycline-regulatable gene expression in mammalian fibroblasts J Cell Biochem 76, 280–9.

Jung, R., Soondrum, K. and Neumaier, M. (2000) Quantitative PCR. Clin Chem Lab Med, 38, 833–836.

Kain, S R. (1997) Use of secreted alkaline phosphatase as a reporter of gene expression in mammalian cells Methods Mol Biol 63, 49–60.

Kao, F. T. and Puck, T. T. (1968) Genetics of somatic mammalian cells, VII. Induction and isolation of nutritional mutants in Chinese hamster cells. Proc Natl Acad Sci USA, 60, 1275–81.

Kellum, R. and Schedl, P. (1992) A group of scs elements function as domain boundaries in an enhancer-blocking assay. Mol Cell Biol, 12, 2424–2431.

Kent, W J. (2002) BLAT—the BLAST-like alignment tool Genome Res 12, 656–64.

Knofler, M, Meinhardt, G, Bauer, S, Loregger, T, Vasicek, R, Bloor, D J, Kimber, S J, and Husslein, P. (2002) Human Hand1 basic helix-loop-helix (bHLH) protein: extra-embryonic expression pattern, interaction partners and identification of its transcriptional repressor domains Biochem J 361, 641–51.

Li, W -H (1997) Molecular Evolution, Sinauer Associates, Sunderland Mass., Meinke, D W, Cherry, J M, Dean, C, Rounsley, S D, and Koornneef, M. (1998) *Arabidopsis thaliana*: a model plant for genome analysis Science 282, 662, 679–82.

Litt, M. D., Simpson, M., Recillas-Targa, F., Prioleau, M. N. and Felsenfeld, G. (2001) Transitions in histone acetylation reveal boundaries of three separately regulated neighboring loci. EMBO J, 20, 2224–2235.

Meyer, P. (2000) Transcriptional transgene silencing and chromatin components Plant Mol Biol 43, 221–34.

Morgenstern, J. P. and Land, H. (1990) Advanced mammalian gene transfer: high titre retroviral vectors with multiple drug selection markers and a complementary helper-free packaging cell line. Nucleic Acids Res, 18, 3587–3596.

Mullen, C. A., Kilstrup, M. and Blaese, R. M. (1992) Transfer of the bacterial gene for cytosine deaminase to mammalian cells confers lethal sensitivity to 5-fluorocytosine: a negative selection system. Proc Natl Acad Sci USA, 89, 33–37.

Nan, X., Javier Campoy, F., and Bird A. (1997) MeCP2 is a transcriptional repressor with abundant binding sites in genomic chromatin. Cell 88, 471–481.

Petersson, K, Ivars, F, and Sigvardsson, M. (2002) The pT alpha promoter and enhancer are direct targets for trans-activation by E box-binding proteins Eur J Immunol 32, 911–20.

Pazin, M. J. and Kadonaga, J. T. (1998) Transcriptional and structural analysis of chromatin assembled in vitro. In Gould, H. (ed.) Chromatin: A Practical Approach. Oxford University Press, Oxford, pp. 172–194.

Pietersen, A. and H. M. Noteborn. (2000) Apoptin. Adv Exp Med Biol 465, 153–161.

Quong, M W, Romanow, W J, and Murre, C. (2002) E protein function in lymphocyte development Annu Rev Immunol 20, 301–22.

Ruezinsky, D, Beckmann, H, and Kadesch, T. (1991) Modulation of the IgH enhancer's cell type specificity through a genetic switch Genes Dev 5, 29–37.

Saluz, H. P. and Jost, J. P. (1993) Approaches to characterize protein-DNA interactions in vivo. Crit Rev Eukaryot Gene Expr, 3, 1–29.

Sambrook, J., Fritsch, E. F. and Maniatis, T. (1989) Molecular Cloning: A Laboratory Manual. Cold Spring Harbor Laboratory Press, Plainview N.Y.

Sanger, F., Nicklen, S. and Coulson, A. R. (1977) DNA sequencing with chain-terminating inhibitors. Proc Natl Acad Sci USA, 74, 5463–5467.

Simizu, B., Rhim, J. S. and Wiebenga, N. H. (1967) Characterization of the Tacaribe group of arboviruses. I. Propagation and plaque assay of Tacaribe virus in a line of African green monkey kidney cells (Vero). Proc Soc Exp Biol Med, 125, 119–123.

Smith, R. L., Traul, D. L., Schaack, J., Clayton, G. H., Staley, K. J. and Wilcox, C. L. (2000) Characterization of promoter function and cell-type-specific expression from viral vectors in the nervous system. J Virol, 74, 11254–11261.

Stam, M, Viterbo, A, Mol, J N, and Kooter, J M. (1998) Position-dependent methylation and transcriptional silencing of transgenes in inverted T-DNA repeats: implications for posttranscriptional silencing of homologous host genes in plants Mol Cell Biol 18, 6165–77.

Stull, R. A., Hyun, W. C. and Pallavicini, M. G. (2000) Simultaneous flow cytometric analyses of enhanced green and yellow fluorescent proteins and cell surface antigens in doubly transduced immature hematopoietic cell populations. Cytometry, 40, 126–134.

Takada, T., Iida, K., Akasaka, K., Yasue, H., Torii, R., Tsujimoto, G., Taira, M. and Kimura, H. (2000) Evaluation of heterologous insulator function with regard to chromosomal position effect in the mouse blastocyst and fetus. Mol Reprod Dev, 57, 232–237.

Tanaka, S., Livingstone-Zatchej, M. and Thoma, F. (1996) Chromatin structure of the yeast URA3 gene at high resolution provides insight into structure and positioning of nucleosomes in the chromosomal context. J Mol Biol, 257, 919–934.

Thomas, J. O. (1998) Isolation and fractionation of chromatin and linker histones. In Gould, H. (ed.) Chromatin: A Practical Approach. Oxford University Press, Oxford, pp. 1–34.

Tiraby, M., Cazaux, C., Baron, M., Drocourt, D., Reynes, J. P. and Tiraby, G. (1998) Concomitant expression of E. coli cytosine deaminase and uracil phosphoribosyltransferase improves the cytotoxicity of 5-fluorocytosine. FEMS Microbiol Lett, 167, 41–49.

Umana, P, Jean-Mairet, J, and Bailey, J E. (1999) Tetracycline-regulated overexpression of glycosyltransferases in Chinese hamster ovary cells Biotechnol Bioeng 65, 542–9.

van der Vlag, J., den Blaauwen, J. L., Sewalt, R. G., van Driel, R. and Otte, A. P. (2000) Transcriptional repression mediated by polycomb group proteins and other chromatin-associated repressors is selectively blocked by insulators. J Biol Chem, 275, 697–704.

van Helden, J, Andre, B, and Collado-Vides, J. (1998) Extracting regulatory sites from the upstream region of yeast genes by computational analysis of oligonucleotide frequencies J Mol Biol 281, 827–42.

van Helden, J, Andre, B, and Collado-Vides, J. (2000) A web site for the computational analysis of yeast regulatory sequences Yeast 16, 177–87.

van Helden, J, Rios, AF, and Collado-Vides, J. (2000) Discovering regulatory elements in non-coding sequences by analysis of spaced dyads Nucleic Acids Res 28, 1808–18.

Vance, V, and Vaucheret, H. (2001) RNA silencing in plants—defense and counterdefense Science 292, 2277–80.

Wallrath, L. L., Swede, M. J. and Elgin, S. C. R. (1998) Mapping chromatin structure in Drosophila. In Gould, H. (ed.) Chromatin: A Practical Approach. Oxford University Press, Oxford, pp. 59–77.

Weaver, L. S. and Kadan, M. J. (2000) Evaluation of adenoviral vectors by flow cytometry. Methods, 21, 297–312.

Wei, K. and Huber, B. E. (1996) Cytosine deaminase gene as a positive selection marker. J Biol Chem 271, 3812–3816.

Wigler, M, Pellicer, A., Silverstein, S. and Axel, R. (1978). Biochemical transfer of single-copy eukaryotic genes using total cellular DNA as donor. Cell 14, 725–731.

Wigley, P., Becker, C., Beltrame, J., Blake, T., Crocker, L., Harrison, S., Lyons, I., McKenzie, Z., Tearle, R., Crawford, R. and et al. (1994) Site-specific transgene insertion: an approach. Reprod Fertil Dev, 6, 585–588.

Xu, Z. Z., Krougliak, V., Prevec, L., Graham, F. L. and Both, G. W. (1995) Investigation of promoter function in human and animal cells infected with human recombinant adenovirus expressing rotavirus antigen VP7sc. J Gen Virol, 76, 1971–1980.

Yang, T T, Sinai, P, Kitts, P A, and Kain, S R. (1997) Quantification of gene expression with a secreted alkaline phosphatase reporter system Biotechniques 23, 1110–4.

Yin, D. X., Zhu, L., and Schimke R. T. (1996) Tetracyclin-controlled gene expression system achieves high-level and quantitative control of gene expression. Analyt Biochem 235, 195–201.

Zink, D, and Paro, R. (1995) Drosophila Polycomb-group regulated chromatin inhibits the accessibility of a transactivator to its target DNA Embo J 14, 5660–71.

TABLE 1

STAR elements improve transgene expression.

| Plasmid | Over-expressing clones, % | Fold over-expression (range) | Number of clones |
|---|---|---|---|
| Empty | 12 | 3–11 | 25 |
| SCS (positive control) | 24 | 3–160 | 21 |
| STAR-6 | 62 | 2–200 | 26 |
| STAR-3 | 39 | 5–820 | 23 |
| STAR-8 | 63 | 7–315 | 19 |
| STAR-4 | 31 | 25–1500 | 13 |
| STAR-1 | 57 | 5–80 | 23 |

Expression of the luciferase reporter gene is measured in cell lines containing integrated pSDH plasmids, without ("empty," the negative control) or containing STAR elements (including the positive control element, SCS from Drosophila). The mean expression level of the negative control is defined as the reference level, and clones are considered over-expressing if their expression level is >2-fold above the reference level. The percentage of over-expressing clones for each plasmid and the fold over-expression is reported, along with the number of clones analyzed for each plasmid.

TABLE 2

Cloned STAR element.

| Clone | Chromosomal location[1] | Adjacent genes[2] | Repeat sequence |
|---|---|---|---|
| STAR-1 | N.d. | | |
| STAR-2 | N.d. | | |
| STAR-3 | For 5q33.3 Rev 10q22.2 | Chr10 part in Histone. Acetyltransferase gene | |
| STAR-4 | For 1p31.1 Rev 14q24.1 | No genes within 10 kb Intron of Regulator of G-protein signalling | 83% repetitive LINE2 & LTR ERV_Class1 |
| STAR-5 | For 3q13.1 Rev 10q22.1* | | |
| STAR-6 | 2p21 | L 5 kb Unknown putative kinase R 20 kb Microtuble associated protein | 19% SINE (MIR) 29% LINE |
| STAR-7 | 1q32.2 | | 12% Alu 4% MIR (SINE) LINE1 2.5% L31CR1 11.5% MER1 7% Low complex 2% |
| STAR-8 | 9q32 | ZFP KRAB box containing Zinc Finger Protein | 35% ERV_ClassI (LTR) 2% simple repeat |
| STAR-9 | See STAR4 | | |
| STAR-10 | N.d. | | |
| STAR-11 | 2p25.1 | R 15 kb unknown DNA binding protein inhibitor (Myc type) | 12% Alu (SINE) 26% MalRs (LINE) |
| STAR-12 | 5q35.3 | R 15 kb unknown ADAM TS2 family metallo proteinase | 3% Low complexity |
| STAR-13 | See STAR4 and 9 | | |
| STAR-14 | F N.d. R 20q13.33 | | |
| STAR-15 | 1p36.36 | L 6 kb Voltage-gated K channel subunit R 4 kb unknown | 14% LTR (MaLRs) |
| STAR-16 | F 8p23.1 R 8p22 etc. | | No repeat on sequenced parts |
| STAR-17 | 2q31.1 | L 6 kb BTEB1 transcription factor R 40 kb HNRNP | 10% simple and low complexity |

[1]Chromosomal location is determined by BLAST search of DNA sequence data from the STAR clones against the human genome database. The location is given according to standard nomenclature referring to the cytogenetic ideogram of each chromosome; e.g., 1p2.3 is the third cytogenetic sub-band of the second cytogenetic band of the short arm of chromosome 1 (www.ncbi.nlm.nih.gov/Class/MLACourse/Genetics/chrombanding-.html). F, forwardsequencing reaction result; R, reverse sequencing reaction result.N.d., not yet determined.
[2]Based on Human Genome Map View Build 22 (//www.ncbi.nlm.nih.gov/cgi-bin/Entrez/hum_srch?chr=hum_chr.inf&query April 2001). L, left; R, right.
*Position ambiguous, several hits

TABLE 3

SINC elements recovered from human chromosome 22 by selection in the pSS vector.

| SINC | Length (nt) | Chromosomal location[1] | Remarks |
|---|---|---|---|
| psinks 9 | 700 | 22q11.21 | Contains LTR; nearest gene ZNF 74, an RNA binding protein. LTR very repetitive. |
| psinks 12 | 750 | 22q12.3 | Located in intron of acetylglucosaminyl-transferase-like protein (664 kb) implicated in tumour formation. |
| psinks 19 | 600 | 22q13.1 | Located in intron of calcium channel, almost exclusively expressed in brain. |
| psinks 28 | 950 | 22q13.31 | Located in intron of kidney protein of unknown function. Contains SINEelement |
| psinks 30 | 700 | 22q13.33 | Contains part of SINE. |

TABLE 3-continued

SINC elements recovered from human chromosome 22 by selection in the pSS vector.

| SINC | Length (nt) | Chromosomal location[1] | Remarks |
|---|---|---|---|
| psinks 35 | 650 | 22q11.21 | Covers exon for solute carrier. (Nuclear gene for mitochondrion). |

[1]Chromosomal location is determined by BLAST search of DNA sequence data from the STAR clones against the human genome database. The location is given according to standard nomenclature referring to the cytogenetic ideogram of each chromosome; e.g., 1p2.3 is the third cytogenetic sub-band of the second cytogenetic band of the short arm of chromosome 1 (www.ncbi.nlm.nih.gov/Class/MLACourse/Genetics/chromb anding-.html).

TABLE 4A

Sequence of various star elements in one strand (forward) or the opposite strand (reverse).

STAR3 forward (SEQ ID NO:125)

ACGTNCTAAGNAAACCATTATTATCATGACATTAACCTATAAAAATAGGC

GTATCACGAGGCCCTTTCGTCTTCACTCGAGCGGCCAGCTTGGATCTCGA

GTACTGAAATAGGAGTAAATCTGAAGAGCAAATAAGATGAGCCAGAAAAC

CATGAAAAGAACAGGGACTACCAGTTGATTCCACAAGGACATTCCCAAGG

TGAGAAGGCCATATACCTCCACTACCTGAACCAATTCTCTGTATGCAGAT

TTAGCAAGGTTATAAGGTAGCAAAAGATTAGACCCAAGAAAATAGAGAAC

TTCCAATCCAGTAAAAATCATAGCAAATTTATTGATGATAACAATTGTCT

CCAAAGGAACCAGGCAGAGTCGTGCTAGCAGAGGAAGCACGTGAGCTGAA

AACAGCCAAATCTGCTTTGTTTTCATGACACAGGAGCATAAAGTACACAC

CACCAACTGACCTATTAAGGCTGTGGTAAACCGATTCATAGAGAGAGGTT

CTAAATACATTGGTCCCTCATAGGCAAACCGCAGTTCACTCCGAACGTAG

TCCCTGGAAATTTGATGTCCAGNATAGAAAAGCANAGCAGNCNNNNNNTA

TANATNNNGNTGANCCANATGNTNNCTGNNC

STAR3 reverse (SEQ ID NO:126)

GAGCTAGCGGCGCGCCAAGCTTGGATCCCGCCCCGCCCCCTCCGCCCTCG

AGCCCCGCCCCTTGCCCTAGAGGCCCTGCCGAGGGGCGGGGCCTGTCCCT

CCTCCCCTTTCCCCCGCCCCTACCGTCACGCTCAGGGGCAGCCTGACCC

CGAGCGGCCCCGCGGTGACCCTCGCGCAGAGGCCTGTGGGAGGGGCGTCG

CAAGCCCCTGAATCCCCCCCGTCTGTTCCCCCCTCCCGCCCAGTCTCCT

CCCCCTGGGAACGCGCGGGGTGGGTGACAGACCTGGCTGCGCGCCACCGC

CACCGCGCCTGCCGGGGCGCTGCCGCTGCCTGAGAAACTGCGGCTGCCG

CCTGGAGGAGGTGCCGTCGCCTCCGCCACCGCTGCCGCCGCCGCCAGGGG

TAGGAGCTAAGCCGCCGCCATTTTGTGTCCCCCTGTTGTTGTCGTTGACA

TGAATCCGACATGACACTGATTACAGCCCAATGGAGTCTCATTAAACCCG

AGTCGCGGTCCCGCCCCGCCGCTGCTCCATTGGAGGAGACCAAAGACACT

TAAGGCCACCCGTTGGCCTACGGGTCTGTCTGTCACCCACTCACTAACCA

TABLE 4A-continued

Sequence of various star elements in one strand (forward) or the opposite strand (reverse).

CTCTGCAGCCCATTGGGGCAGGTTCCTGCCGGTCATNTCGCTTCCAATAA

ACACACCCCTTCGACCCCATNATTCCCCCCCTTCGGGAACCACCCCCGGG

GGAGGGGTCCACTGGNCAATACCAATTNAANAGAACCGCTNGGGTCCGCC

TNTTTNCGGGCNCCCTATTGGGTT

STAR4 forward (SEQ ID NO:127)

GGGGAGGATTCTTTTGGCTGCTGAGTTGAGATTAGGTTGAGGGTAGTGAA

GGTAAAGGCAGTGAGACCACGTAGGGGTCATTGCAGTAATCCAGGCTGGA

GATGATGGTGGTTCAGTTGGAATAGCAGTGCATGTGCTGTAACAACCTCA

GCTGGGAAGCAGTATATGTGGCGTTATGACCTCAGCTGGAACAGCAATGC

ATGTGGTGGTGTAATGACCCCAGCTGGGTAGGGTGCATGTGATGGAACAA

CCTCAGCTGGGTAGCAGTGTACTTGATAAAATGTTGGCATACTCTACATT

TGTTATGAGGGTAGTGCCATTAAATTTCTCCACAAATTGGTTGTCACGTA

TGAGTGAAAAGAGGAAGTGATGGAAGACTTCAGTGCTTTTGGCCTGAATA

AATAGAAGACGTCATTTTCAGTAATGGAGACAGGGAAGACTAANGNAGGG

TGGATTCAGTAGAGCAGGTGTTCAGTTTTGAATATGATGAACTCTGAGAG

AGGAAAAACTTTTTCTACCTCTTAGTTTTTGNGNCTGGACTTAANATTAA

AGGACATANGACNGAGANCAGACCAAATNTGCGANGTTTTTATATTTTAC

TTGCNGAGGGAATTTNCAAGAAAAAGAAGACCCAANANCCATTGGTCAAA

ACTATNTGCCTTTTAANAAAAAGANAATTACAATGGANANANAAGTGTTG

NCTNGGCAAAAATTGGG

STAR4 reverse (SEQ ID NO:128)

GGATTNGAGCTAGCGGCGCGCCAAGCTTGGATCTTAGAAGGACAGAGTGG

GGCATGGAAATGCACCACCAGGGCAGTGCAGCTTGGTCACTGCCAGCTCC

NCTCATGGGCAGAGGGCTGGCCTCTTGCAGCCGACCAGGCACTGAGCGCC

ATCCCAGGGCCCTCGCCAGCCCTCAGCAGGGCCAGGACACACAAGCCTTT

GACTTCCTCCTGTCACTGCTGCTGCCATTCCTGTTTTGTGGTCATCACTC

CTTCCCTGTCCTCAGACTGCCCAGCACTCAAGGATGTCCTGTGGTGGCAT

CAGACCATATGCCCCTGAANAGGAGTGAGTTGGTGTTTTTTGCCGCGCCC

ANAGAGCTGCTGTCCCCTGAAAGATGCAAGTGGGAATGATGATGNTCACC

ATCNTCTGACACCAAGCCCTTTGGATAGAGGCCCCAACAGTGAGGATGGG

GCTGCACTGCATTGCCAAGGCAACTCTGTNNTGACTGCTACANGACANTC

CCAGGACCTGNGAAGNNCTATANATNTGATGCNAGGCACCT

STAR6 forward (SEQ ID NO:129)

CCACCACAGACATCCCCTCTGGCCTCCTGAGTGGTTTCTTCAGCACAGCT

TCCAGAGCCAAATTAAACGTTCACTCTATGTCTATAGACAAAAAGGGTTT

TGACTAAACTCTGTGTTTTAGAGAGGGAGTTAAATGCTGTTAACTTTTTA

GGGGTGGGCGAGAGGAATGACAAATAACAACTTGTCTGAATGTTTTACAT

TTCTCCCCACTGCCTCAAGAAGGTTCACAACGAGGTCATCCATGATAAGG

TABLE 4A-continued

Sequence of various star elements in one strand (forward) or the opposite strand (reverse).

AGTAAGACCTCCCAGCCGGACTGTCCCTCGGCCCCCAGAGGACACTCCAC

AGAGATATGCTAACTGGACTTGGAGACTGGCTCACACTCCAGAGAAAAGC

ATGGAGCACGAGCGCACAGAGCANGGGCCAAGGTCCCAGGGACNGAATGT

CTAGGAGGGAGATTGGGGTGAGGGTANTCTGATGCAATTACTGNGCAGCT

CAACATTCAAGGGAGGGAAGAAAGAAACNGTCCCTGTAAGTAAGTTGTN

CANCAGAGATGGTAAGCTCCAAATTTNAACTTTGGCTGCTGGAAAGTTTN

NGGGCCNANANAANAAACANAAANATTTGAGGTTTANACCCACTAACCCN

TATNANTANTTATTAATACCCCTAATTANACCTTGGATANCCTTAAAATA

TCNTNTNAAACGGAACCCTCNTTCCCNTTTNNAAATNNNAAAGGCCATTN

NGNNCNAGTAAAAATCTNNNTTAAGNNNTGGGCCCNAACAAACNTNTTCC

NAGACACNTTTTTTNTCCNGGNATTTNTAATTTATTTCTAANCC

STAR6 reverse (SEQ ID NO:130)

ATCGTGTCCTTTCCAGGGACATGGATGAAGCTGGAAGCCATCATCCTCAG

CAAACTAACACAGGAACAGAAAACCAAATACCACATGTTCTCACTCATAA

GTGGGAGCTGAACAGTGAGAACACATGGACACAGGGAGGGAACATCACA

CACCAAGGCCTGTCTGGTGTGGGAGGGGAGGGAGAGCATCAGGACAAAT

AGCTAATGCATGTGGGGCTTAAACCTAGATGACGGGTTGATAGGTGCAGC

AATCCACTATGGACACATATACCTATGTAACAACCCNACCTTNTTGACAT

GTATCCCAGAACTTAAAGGAAAATAAAAATTAAAAAAAATTNCCCTGGAA

TAAAAAAGAGTGTGGACTTTGGTGAGATN

STAR8 forward (SEQ ID NO:131)

GGATCACCTCGAAGAGAGTCTAACGTCCGTAGGAACGCTCTCGGGTTCAC

AAGGATTGACCGAACCCCAGGATACGTCGCTCTCCATCTGAGGCTTGNTC

CAAATGGCCCTCCACTATTCCAGGCACGTGGGTGTCTCCCCTAACTCTCC

CTGCTCTCCTGAGCCCATGCTGCCTATCACCCATCGGTGCAGGTCCTTTC

TGAANAGCTCGGGTGGATTCTCTCCATCCCACTTCCTTTCCCAAGAAAGA

AGCCACCGTTCCAAGACACCCAATGGGACATTCCCNTTCCACCTCCTTNT

CNAAAGTTNGCCCAGGTGTTCNTAACAGGTTAGGGAGAGAANCCCCCAGG

TTTNAGTTNCAAGGCATAGGACGCTGGCTTGAACACACACACACNCTC

STAR8 reverse (SEQ ID NO:132)

GGATCCCGACTCTGCACCGCAAACTCTACGGCGCCCTGCAGGACGGCGGC

CTCCTGCCGCTTGGACGCCAGNCAGGAGCTCCCCGGCAGCAGCAGAGCAG

AAAGAAGGATGGCCCCGCCCCACTTCGCCTCCCGGCGGTCTCCCTCCCGC

CGGCTCACGGACATAGATGGCTGCCTAGCTCCGGAAGCCTAGCTCTTGTT

CCGGGCATCCTAAGGAAGACACGGTTTTTCCTCCCGGGGCCTCACCACAT

CTGGGACTTTGACGACTCGGACCTCTCTCCATTGAATGGTTGCGCGTTCT

CTGGGAAAG

STAR18 forward (SEQ ID NO:133)

TGGATCCTGCCGCTCGCGTCTTAGTGTTTCTCCCTCAAGACTTTCCTTCT

GTTTTGTTGTCTTGTGCAGTATTTTACAGCCCCTCTTGTGTTTTTCTTTA

TTTCTCGTACACACACGCAGTTTTAAGGGTGATGTGTGTATAATTAAAAG

GACCCTTGGCCCATACTTTCCTAATTCTTTAGGGACTGGGATTGGGTTTG

ACTGAAATATGTTTTGGTGGGATGGGACGGTGGACTTCCATTCTCCCTA

AACTGGAGTTTTGGTCGGTAATCAAAACTAAAAGAAACCTCTGGGAGACT

GGAAACCTGATTGGAGCACTGAGGAACAAGGGAATGAAAAGGCAGACTCT

CTGAACGTTTGATGAAATGGACTCTTGTGAAAATTAACAGTGAATATTCA

CTGTTGCACTGTACGAAGTCTCTGAAATGTAATTAAAAGTTTTTATTGAG

CCCCCGAGCTTTGGCTTGCGCGTATTTTTCCGGTCGCGGACATCCCACCG

CGCAGAGCCTCGCCTCCCCGCTGNCCTCAGCTCCGATGACTTCCCCGCCC

CCGCCCTGCTCGGTGACAGACGTTCTACTGCTTCCAATCGGAGGCACCCT

TCGCGG

STAR18 reverse (SEQ ID NO:134)

TGGATCCTGCCGCTCGCGTCTTAGTGTTTCTCCCTCAAGACTTTCCTTCT

GTTTTGTTGTCTTGTGCAGTATTTTACAGCCCCTCTTGTGTTTTTCTTTA

TTTCTCGTACACACACGCAGTTTTAAGGGTGATGTGTGTATAATTAAAAG

GACCCTTGGCCCATACTTTCCTAATTCTTTAGGGACTGGGATTGGGTTTG

ACTGAAATATGTTTTGGTGGGATGGGACGGTGGACTTCCATTCTCCCTA

AACTGGAGTTTTGGTCGGTAATCAAAACTAAAAGAAACCTCTGGGAGACT

GGAAACCTGATTGGAGCACTGAGGAACAAGGGAATGAAAAGGCAGACTCT

CTGAACGTTTGATGAAATGGACTCTTGTGAAAATTAACAGTGAATATTCA

CTGTTGCACTGTACGAAGTCTCTGAAATGTAATTAAAAGTTTTTATTGAG

CCCCCGAGCTTTGGC

TABLE 4B the sequence of various sine elements

PSINKS 9 (SEQ ID NO:135)

GATCAGGA TAATAAGTAC GCTGGAAGA CAACAAAATG

ATTTAAATCT TAGACAAGTC ATTCTAGGTG TCTCCACTGT

TTCAGTTCTT GCATTCATTC TTGTGGTATC TTTTCCCTTT

TACCAATAAA AAAGCTCCCT GACATCACAT TGTGGCAGTC

CCCATGGTTT GCCGCAGTTA CTGCGGGACT GAACGAAGGA

GGACGAATGA AGAAATGAAA ACCAAGGAAA AAAGGAGCTG

TTTAAAGAAG GGTCCAGGGA AGAAGAAGAG GGCTCCCAGC

TTCTAGTGAG CAAGGGCAGC AGCCCTGAGC TTCTACAGCC

TABLE 4B-continued the sequence of various sine elements

CTTCATATTT ATTGAGTAGA AAGAGCAGGG AGCAGGAGGT

AATGATTGGT CAGCTTCTCA ATTGATCACA GGTTCACATT

ATTGCTAACA GATTTCACAT GTGCCTAATC TCAAGAAACG

CCGCGCCTGG GGCATGACTG CCCTCAGCAT TCCCTCTGGG

TGGCAGACGC AGTTTGCCAA CATTCTGCAT TCATGAGAAC

AGTTTACTGT TTACTCATAT AACCTCCAGT GGTACACCGA

GTTGATC

PSINKS 12 (SEQ ID NO:136)

GATCTAA TTTCTCTGTA TTTAATTCCC ATGTCTATTT

TGTCTATTTT CAAGATTGAT TTACATTGCA GGTTCCGATG

CAACCACTGA CTTACATTGC AGGTTCTAAT GTAACCACTG

TCCTTAACGA GTACATAGAT TTGTTTCCTT CTCTCCAGGA

GCATGAGATT TGTTGCCTCC AGGAAAGGCA ACAAATCTAC

TATTCCTTA AGGACAGTGG TTCTCAAAGG ATTGTCCTGG

GAACAGCAGC ATCACCTACA CAGTAGTTAG AAATGCACAT

TCTGAGGCCT CCCAAGACCT GCTAACTCAG ACACTTGGGG

AGAAGAAGGG GTTCCAACAA GCCTTCTAGG TCATTCTGAT

GCATGCTGGA GTTTGAGAAT CGATGCTCTA GGAAAAACAC

CAGTACTAT CTACCATCAA CTTGACCACT CAAGTGTCAC

CATTCACTGA AGTTAACTA CAATGTCCAG AGAATTAATT

GTGTACCAGG CACTATGCGG AAGGCTGAAT GCTGCCTCAC

AATCCANAGT GGTATGTGTG TAAATGACTA AATAAAATGC

AAAATGGGAT GACATG

PSINKS 19 (SEQ ID NO:137)

G ATCCTCCATC TGCTCCACCC ACTTCCATGT AAGTGATCCT

GGGCTGATCA CTTCCTCTCT CTAGACTTCG TTTCTTTTTT

TTCTTTTTTA GACCGAGTCT CACTCTGTCA CCCAGGCTGG

AGTGCAGTGG TGAGATCTTG GCTCACTGCA ACCTCCACCT

CCTGGGTTCA AGCAATTCTC CTGTCTCAGC CTCCTGAGTA

GATAGGACTA TAGGTGCACA CCACCATACC TAGCTAATTT

TTGTTTTTTT AGTAGAGATG GGGTTTCACC ATATTGGTCA

GCCTGTTCTC AAACTCCTGA CCTCAGGTGA TCCACCCACC

TCAGCCTCCC AAAGTGCTGG GATTACAGGT GTGAGCCACC

GAGCCGGGCT GCCCTTCTCT GGACTTTGAT TTCCTCATCT

ATAAAACAGA CAACAATCCC TACTATGACC ATCCAGAAGG

GTTAATCTAT GCTTCATTGC AATCCTAATC AAAAATCCCA

ACATTTTGGC CGTGGAGCCT GCCCAGATGG TTCTAGGATT

TATTTGGATG GGAAAATAGT CAAGACAAGC TT

PSINKS 28 (SEQ ID NO:138)

GAT CATGGAGGGA GAGAACAACC AACCACACAC

TGACTGGTCA CCCCTGAAGT TCACAGCCAC TACCCTGTAG

AGGCCCCGAG GTTGCCGGCA AGCCCAGTAT ACTTCCATCT

AAACTCCCCT TGCACCTGCT CCTCCTGTTC CAGACAATGA

GCTGTAACAC GCACATCCAC ACCACACATC ACCCACAGCA

GGGGCAGGAG GCAGCTAAGC ATGGGCTTCA GAGTCCTCCC

ACCAGCAGCG CCTACCAGCT ACAAGCCTGA CGTCTCTGTG

TGTGTGTGTA AATTTCACTA AATATTTCTT CCTTTGTTTT

TTAAAAATTT ACATGAAATG CACATTTTTG CTGTGACAGA

AGCATGTAAC TGTGATCCTA ACACACCTAC TCCTCCGCCT

TTTACTGCCG TCTGCTTCCC TCTCTTCTCC ACGCCCACTC

GACTGCAGTA TCGATGCCAA CAACATGATG TGTGTCCTTC

CATGTTTCCC TGCTCATGCA TTCGCATGTA AGCCACCGCA

CATGTCACTG TATGTACACA CAGGGGATTC TGAGGCCAAT

GTTTTACAAG GATTACGTTA TACACCCTTT TCTGCAGTGA

GTTTTTCCCA GGCAACCTCC CAGGCCCCAT GGTGTAGCTC

TGGGTCAATC CTTTTTTTTT TTTTTGGAGA CAGAGTCTCA

CTCTGTCGCC CAGGCTGGAG TGCAGTGGTG CAATTTGGGC

TCACTGCAAC CTCCGCCTCC CGGGTTCAAG CGATTCTCCT

GCCTCAGCCT CCTGAGTAGC TGACATTACA AGCGCGCACT

ACCACACCCG GCTAATTTTT GTATTTTTAG TAGAGATACA

GTTTCACCAT GTTGGTCAGG CTGGTCTTGA ACTCCTGAGC

TCGTGATC

PSINKS 30 (SEQ ID NO:139)

GATCC ACCCGCCTCG GACTCCCAAA GTGCTGGGAT

TACAGGTGTG AGCCACTGTG CTTGGCCCGA ATCAGGAATA

ATTCTGATGG CTAAGGAAGA CAGCTTCCGA GAGAGTAGGA

GAAAGGGCAC AGGATTCCAG GCAGAAGGCC CATCTAGGGC

AAAGGCGAAG GTGTGGCTCA GCCTGCCTCC TTTGGGGAAT

GGCGAGTGTG TTCTGGGCTC AGGGTTCTTG GTAAGGGACA

GAGAAGACTC GGGAAAGATC AGTTGAGCTG GAATGTGCAG

GCTCTTGAGT ACCCTGCTCA GGAGCTGGAG GTGGGCTACC

CTGCAAACTC CAGGCCATGA AGCCCAGGAA GATGTCAGGC

TGGTCTTCCC ATGCCCTTGT GTATCTGAGA CCAACTGTCA

CTAAATGTTT CCTTTACGCC CTGGACACAC AGCTAGACTC

TACTTCTCAG ATTCTCTTGA AATACAAGTC TTTAGCCAGA

GGGTGTGGAG GGAAATGCTG TGTATCACTT TGAGGTTGAG

TABLE 4B-continued the sequence of various sine elements

GCCATCAAAG CCTCCCACAG GTGGCCCCCT CTTTCTCTCC

CCACGTACTT ATGATGTTGA TGCCCAAGGC AGCTTGAGTA

CTACCTGCTG AAGGCAGGGC CTCTGTCACC ATAGATC

PSINKS 35 (SEQ ID NO:140)

GATCCAC CTGCCTCGGC CTCCCAAAGT GCTGGGATTA

CAGGCATGAG CCACCATGCC TGGCCAAAAA CTTCTACCTG

CTTGGAAAGT TGACTGGTCA CACAGCCTAG CAAATGAGGT

TGGGATGTGG GATGTGCCTG GTTCCAATCC CAGCCCTTTA

CTGTTCCCAT AGGAGGTGGG GACAGGCCTC ACCCAGGCGT

CCAGCATCCT GCAGCTGAAT CTTGAGCATT TCCATGGGAC

AGGTCACCAC GACCTGGCAC ATCCCAGCCC CACACCCGGC

AAGCATCTCC ATCTTCAGGT TCCGCTGCAT CCTATGGGAA

CAGGCGTCAG GCTCCTTCAG CCGCAGGCCA CAGGCCTGCC

CTGGTGCAGC TGCCCTCTTG TGAGAGGGGG ACTTTCCCTG

GATGGCACCC GTGGCTGCCA CTCACCCAGC TGGTCAAGTC

ATCAGCTAGC CCTTAGGTGT GGTCTCTGTA CGGACAGGGG

ACTAAGTTTA AAACAAAGCC TGCTAGGGAG GTAGCACCGC

ATGGAAGCTG AAACAGTGAC AGAGAAAACT ACCCAGACCA

GGCGTTGTCC TTGATC

TABLE 5

Oligonucleotides used for polymerase chain reactions (PCR primers) or DNA mutagenesis Number Sequence

C65 AACAAGCTTGATATCAGATCTGCTAGCTTGGTCGAGCTGATAC
TTCCC (SEQ ID NO:141)

C66 AAACTCGAGCGGCCGCGAATTCGTCGACTTTACCACTCCCTAT
CAGTGATAGAG (SEQ ID NO:142)

C67 AAACCGCGGCATGGAAGACGCCAAAAACATAAAGAAAGG
(SEQ ID NO:143)

C68 TATGGATCCTAGAATTACACGGCGATCTTTCC
(SEQ ID NO:144)

C81 AAACCATGGCCGAGTACAAGCCCACGGTGCGCC
(SEQ ID NO:145)

C82 AAATCTAGATCAGGCACCGGGCTTGCGGGTCATGC
(SEQ ID NO:146)

C85 CATTTCCCCGAAAAGTGCCACC
(SEQ ID NO:147)

D30 TCACTGCTAGCGAGTGGTAAACTC
(SEQ ID NO:148)

D41 GAAGTCGACGAGGCAGGCAGAAGTATGC
(SEQ ID NO:149)

D42 GAGCCGCGGTTTAGTTCCTCACCTTGTCG
(SEQ ID NO:150)

D51 TCTGGAAGCTTTGCTGAAGAAAC
(SEQ ID NO:151)

D89 GGGCAAGATGTCGTAGTCAGG
(SEQ ID NO:152)

D90 AGGCCCATGGTCACCTCCATCGCTACTGTG
(SEQ ID NO:153)

D91 CTAATCACTCACTGTGTAAT
(SEQ ID NO:154)

D93 AATTACAGGCGCGCC
(SEQ ID NO:155)

D94 AATTGGCGCGCCTGT
(SEQ ID NO:156)

D95 TGCTTTGCATACTTCTGCCTGCCTC
(SEQ ID NO:157)

E12 TAGGGGGATCCAAATGTTC
(SEQ ID NO:158)

E13 CCTAAAAGAAGATCTTTAGC
(SEQ ID NO:159)

E14 AAGTGTTGGATCCACTTTGG
(SEQ ID NO:160)

E15 TTTGAAGATCTACCAAATGG
(SEQ ID NO:161)

E16 GTTCGGGATCCACCTGGCCG
(SEQ ID NO:162)

E17 TAGGCAAGATCTTGGCCCTC
(SEQ ID NO:163)

E18 CCTCTCTAGGGATCCGACCC
(SEQ ID NO:164)

E19 CTAGAGAGATCTTCCAGTAT
(SEQ ID NO:165)

E20 AGAGTTCCGGATCCGCCTGG
(SEQ ID NO:166)

E21 CCAGGCAGACTCGGAACTCT
(SEQ ID NO:167)

E22 TGGTGAAACCGGATCCCTAC
(SEQ ID NO:168)

E23 AGGTCAGGAGATCTAGACCA
(SEQ ID NO:169)

E25 CCATTTTCGCTTCCTTAGCTCC
(SEQ ID NO:170)

E42 CGATGTAACCCACTCGTGCACC
(SEQ ID NO:171)

E57 AGAGATCTAGGATAATTTCG
(SEQ ID NO:172)

E92 AGGCGCTAGCACGCGTTCTACTCTTTTCCTACTCTG
(SEQ ID NO:173)

TABLE 5-continued

Oligonucleotides used for polymerase chain reactions (PCR primers) or DNA mutagenesis

| Number | Sequence |
|---|---|
| E93 | GATCAAGCTTACGCGTCTAAAGGCATTTTATATAG (SEQ ID NO:174) |
| E94 | AGGCGCTAGCACGCGTTCAGAGTTAGTGATCCAGG (SEQ ID NO:175) |
| E95 | GATCAAGCTTACGCGTCAGTAAAGGTTTCGTATGG (SEQ ID NO:176) |
| E96 | AGGCGCTAGCACGCGTTCTACTCTTTCATTACTCTG (SEQ ID NO:177) |
| E97 | CGAGGAAGCTGGAGAAGGAGAAGCTG (SEQ ID NO:178) |
| E98 | CAAGGGCCGCAGCTTACACATGTTC (SEQ ID NO:179) |
| D58 | CCAAGTTGACCAGTGCC (SEQ ID NO:180) |
| D80 | GTTCGTGGACACGACCTCCG (SEQ ID NO:181) |
| D70 | TACAAGCCAACCACGGCCT (SEQ ID NO:182) |
| D71 | CGGAAGTGCTTGACATTGGG (SEQ ID NO:183) |

TABLE 6

STAR elements of the invention, including genomic location and length

| STAR | Location[1] | Length[2] |
|---|---|---|
| 1 (SEQ ID NO:1) | 2q31.1 | 750 |
| 2 (SEQ ID NO:2) | 7p15.2 | 916 |
| 3[3] (SEQ ID NO:3) | 15q11.2 and 10q22.2 | 2132 |
| 4 (SEQ ID NO:4) | 1p31.1 and 14q24.1 | 1625 |
| 5[4] (SEQ ID NO:5) | 20q13.32 | 1571 |
| 6 (SEQ ID NO:6) | 2p21 | 1173 |
| 7 (SEQ ID NO:7) | 1q34 | 2101 |
| 8 (SEQ ID NO:8) | 9q32 | 1839 |
| 9[4] (SEQ ID NO:9) | 10p15.3 | 1936 |
| 10 (SEQ ID NO:10) | Xp11.3 | 1167 |
| 11 (SEQ ID NO:11) | 2p25.1 | 1377 |
| 12 (SEQ ID NO:12) | 5q35.3 | 1051 |
| 13[4] (SEQ ID NO:13) | 9q34.3 | 1291 |
| 14[4] (SEQ ID NO:14) | 22q11.22 | 732 |
| 15 (SEQ ID NO:15) | 1p36.31 | 1881 |
| 16 (SEQ ID NO:16) | 1p21.2 | 1282 |
| 17 (SEQ ID NO:17) | 2q31.1 | 793 |
| 18 (SEQ ID NO:18) | 2q31.3 | 497 |
| 19 (SEQ ID NO:19) | 6p22.1 | 1840 |
| 20 (SEQ ID NO:20) | 8p13.3 | 780 |
| 21 (SEQ ID NO:21) | 6q24.2 | 620 |
| 22 (SEQ ID NO:22) | 2q12.2 | 1380 |
| 23 (SEQ ID NO:23) | 6p22.1 | 1246 |
| 24 (SEQ ID NO:24) | 1q21.2 | 948 |
| 25[5] (SEQ ID NO:25) | 1q21.3 | 1067 |
| 26 (SEQ ID NO:26) | 1q21.1 | 540 |
| 27 (SEQ ID NO:27) | 1q23.1 | 1520 |
| 28 (SEQ ID NO:28) | 22q11.23 | 961 |
| 29 (SEQ ID NO:29) | 2q13.31 | 2253 |
| 30 (SEQ ID NO:30) | 22q12.3 | 1851 |
| 31 (SEQ ID NO:31) | 9q34.11 and 22q11.21 | 1165 |
| 32 (SEQ ID NO:32) | 21q22.2 | 771 |
| 33 (SEQ ID NO:33) | 21q22.2 | 1368 |
| 34 (SEQ ID NO:34) | 9q34.14 | 755 |
| 35 (SEQ ID NO:35) | 7q22.3 | 1211 |
| 36 (SEQ ID NO:36) | 21q22.2 | 1712 |
| 37 (SEQ ID NO:37) | 22q11.23 | 1331 |
| 38 (SEQ ID NO:38) | 22q11.1 and 22q11.1 | ~1000 |
| 39 (SEQ ID NO:39) | 22q12.3 | 2331 |
| 40 (SEQ ID NO:40) | 22q11.21 | 1071 |
| 41 (SEQ ID NO:41) | 22q11.21 | 1144 |
| 42 (SEQ ID NO:42) | 22q11.1 | 735 |
| 43 (SEQ ID NO:43) | 14q24.3 | 1231 |
| 44 (SEQ ID NO:44) | 22q11.1 | 1591 |
| 45 (SEQ ID NO:45) | 22q11.21 | 1991 |
| 46 (SEQ ID NO:46) | 22q11.23 | 1871 |
| 47 (SEQ ID NO:47) | 22q11.21 | 1082 |
| 48 (SEQ ID NO:48) | 22q11.22 | 1242 |
| 49 (SEQ ID NO:49) | Chr 12 random clone, and 3q26.32 | 1015 |
| 50 (SEQ ID NO:50) | 6p21.31 | 2361 |
| 51 (SEQ ID NO:51) | 5q21.3 | 2289 |
| 52 (SEQ ID NO:52) | 7p15.2 | 1200 |
| 53 (SEQ ID NO:53) | Xp11.3 | 1431 |
| 54 (SEQ ID NO:54) | 4q21.1 | 981 |
| 55 (SEQ ID NO:55) | 15q13.1 | 501 |
| 56 (SEQ ID NO:56) | includes 3p25.3 | 741 |
| 57 (SEQ ID NO:57) | 4q35.2 | 1371 |

TABLE 6-continued

STAR elements of the invention, including genomic location and length

| STAR | Location[1] | Length[2] |
|---|---|---|
| 58 (SEQ ID NO:58) | 21q11.2 | 1401 |
| 59 (SEQ ID NO:59) | 17 random clone | 872 |
| 60 (SEQ ID NO:60) | 4p16.1 and 6q27 | 2068 |
| 61 (SEQ ID NO:61) | 7p14.3 and 11q25 | 1482 |
| 62 (SEQ ID NO:62) | 14q24.3 | 1011 |
| 63 (SEQ ID NO:63) | 22q13.3 | 1421 |
| 64 (SEQ ID NO:64) | 17q11.2 | 1414 |
| 65 (SEQ ID NO:65) | 7q21.11 = 28.4 | 1310 |
| 66 (SEQ ID NO:66) | 20q13.33 and 6q14.1 | ~2800 |

[1]Chromosomal location is determined by BLAST search of DNA sequence data from the STAR elements against the human genome database. The location is given according to standard nomenclature referring to the cytogenetic ideogram of each chromosome; e.g., 1p2.3 is the third cytogenetic sub-band of the second cytogenetic band of the short arm of chromosome 1 (http://www.ncbi.nlm.nih.gov/Class/MLACourse/Genetics/chrombanding-.html). In cases where the forward andreverse sequencing reaction identified DNAs from different genomic loci, both loci are shown.
[2]Precise lengths are determined by DNA sequence analysis; approximate lengths are determined by restriction mapping.
[3]Sequence and location of STAR3 has been refined since assembly of Tables 2 and 4.
[4]The STARs with these numbers in Tables 2 and 4 have been set aside (hereafter referred to as "oldSTAR5" etc.) and their numbers assigned to the STAR elements shown in the DNA sequence appendix. In the case of oldSTAR5, oldSTAR14, and oldSTAR16, the cloned DNAs were chimeras from more than two chromosomal locations; in the case of oldSTAR9 and oldSTAR13, the cloned DNAs were identical to STAR4.
[5]Identical to Table 4 "STAR18".

TABLE 7

STAR elements convey stability over time on transgene expression[1]

| | Cell Divisions[2] | Luciferase Expression[3] |
|---|---|---|
| STAR6 plus puromycin | 42 | 18,000 |
| | 60 | 23,000 |
| | 84 | 20,000 |
| | 108 | 16,000 |
| STAR6 without puromycin[4] | 84 | 12,000 |
| | 108 | 15,000 |
| | 144 | 12,000 |

[1]Plasmid pSDH-Tet-STAR6 was transfected into U-2 OS cells, and clones were isolated and cultivated in doxycycline-free medium as described in Example 1. Cells were transferred to fresh culture vessels weekly at a dilution of 1:20.
[2]The number of cell divisions is based on the estimation that in one week the culture reaches cell confluence, which represents ~6 cell divisions.
[3]Luciferase was assayed as described in Example 1.
[4]After 60 cell divisions the cells were transferred to two culture vessels; one was supplied with culture medium that contained puromycin, as for the first 60 cell divisions, and the second was supplied with culture medium lacking antibiotic.

TABLE 8

Human STAR elements and their putative mouse orthologs and paralogs

| SEQ: ID | STAR | Human[1] | Mouse[2] | Similarity[3] |
|---|---|---|---|---|
| 1 | 1 | 2q31.1 | 2D | 600 bp 69% |
| 2 | 2 | 7p15.2 | 6B3 | 909 bp 89% |
| 3 | 3a | 5q33.3 | 11B2 | 248 bp 83% |
| 4 | 3b | 10q22.2 | 14B | 1.363 bp 89% |
| | | | | 2.163 bp 86% |
| 5 | 6 | 2p21 | 17E4 | 437 bp 78% |
| 6 | 12 | 5q35.3 | 11b1.3 | 796 bp 66% |
| 7 | 13 | 9q34.3 | 2A3 | 753 bp 77% |
| 8 | 18 | 2q31.3 | 2E1 | 497 bp 72% |
| 9 | 36 | 21q22.2 | 16C4 | 166 bp 79% |
| 10 | 40 | 22q11.1 | 6F1 | 1.270 bp 75% |
| | | | | 2.309 bp 70% |
| 11 | 50 | 6p21.31 | 17B1 | 1.451 bp 72% |
| | | | | 2.188 bp 80% |
| | | | | 3.142 bp 64% |
| 12 | 52 | 7p15.2 | 6B3 | 1.846 bp 74% |
| | | | | 2.195 bp 71% |
| 13 | 53 | Xp11.3 | XA2 | 364 bp 64% |
| 14 | 54 | 4q21.1 | 5E3 | 1.174 bp 80% |
| | | | | 2.240 bp 73% |
| | | | | 3.141 bp 67% |
| | | | | 4.144 bp 68% |
| 15 | 61a | 7p14.3 | 6B3 | 188 bp 68% |

[1]Cytogenetic location of STAR element in the human genome.
[2]Cytogenetic location of STAR element ortholog in the mouse genome.
[3]Length of region(s) displaying high sequence similarity, and percentage similarity. In some cases more than one block of high similarity occurs; in those cases, each block is described separately. Similarity <60% is not considered significant.

TABLE 9

Oligonucleotide patterns (6 base pairs) over-represented in STAR elements.
The patterns are ranked according to significance coefficient.
These were determined using RSA-Tools with the sequence of the human genome as reference. Patterns that comprise the most discriminant variables in Linear Discriminant Analysis are indicated with an asterisk.

| Number | Oligonucleotide sequence | Observed occurrences | Expected occurrences | Significance coefficient | Number of matching STARs |
|---|---|---|---|---|---|
| 1 | CCCCAC | 107 | 49 | 8.76 | 51 |
| 2 | CAGCGG | 36 | 9 | 7.75 | 23 |
| 3 | GGCCCC | 74 | 31 | 7.21 | 34 |
| 4 | CAGCCC | 103 | 50 | 7.18 | 37 |
| 5 | GCCCCC | 70 | 29 | 6.97 | 34 |
| 6 | CGGGGC | 40 | 12 | 6.95 | 18 |
| 7 | CCCCGC | 43 | 13 | 6.79 | 22 |
| 8 | CGGCAG | 35 | 9 | 6.64 | 18 |
| 9 | AGCCCC | 83 | 38 | 6.54 | 40 |
| 10 | CCAGGG | 107 | 54 | 6.52 | 43 |
| 11 | GGACCC* | 58 | 23 | 6.04 | 35 |
| 12 | GCGGAC | 20 | 3 | 5.94 | 14 |
| 13 | CCAGCG | 34 | 10 | 5.9 | 24 |
| 14 | GCAGCC | 92 | 45 | 5.84 | 43 |
| 15 | CCGGCA | 28 | 7 | 5.61 | 16 |
| 16 | AGCGGC | 27 | 7 | 5.45 | 17 |
| 17 | CAGGGG | 86 | 43 | 5.09 | 43 |
| 18 | CCGCCC | 43 | 15 | 5.02 | 18 |
| 19 | CCCCCG | 35 | 11 | 4.91 | 20 |
| 20 | GCCGCC | 34 | 10 | 4.88 | 18 |
| 21 | GCCGGC | 22 | 5 | 4.7 | 16 |
| 22 | CGGACC | 19 | 4 | 4.68 | 14 |
| 23 | CGCCCC | 35 | 11 | 4.64 | 19 |
| 24 | CGCCAG | 28 | 8 | 4.31 | 19 |
| 25 | CGCAGC | 29 | 8 | 4.29 | 20 |
| 26 | CAGCCG | 32 | 10 | 4 | 24 |

TABLE 9-continued

Oligonucleotide patterns (6 base pairs) over-represented in STAR elements. The patterns are ranked according to significance coefficient. These were determined using RSA-Tools with the sequence of the human genome as reference. Patterns that comprise the most discriminant variables in Linear Discriminant Analysis are indicated with an asterisk.

| Number | Oligonucleotide sequence | Observed occurrences | Expected occurrences | Significance coefficient | Number of matching STARs |
|---|---|---|---|---|---|
| 27 | CCCACG | 33 | 11 | 3.97 | 26 |
| 28 | GCTGCC | 78 | 40 | 3.9 | 43 |
| 29 | CCCTCC | 106 | 60 | 3.87 | 48 |
| 30 | CCCTGC* | 92 | 50 | 3.83 | 42 |
| 31 | CACCCC | 77 | 40 | 3.75 | 40 |
| 32 | GCGCCA | 30 | 10 | 3.58 | 23 |
| 33 | AGGGGC | 70 | 35 | 3.55 | 34 |
| 34 | GAGGGC | 66 | 32 | 3.5 | 40 |
| 35 | GCGAAC | 14 | 2 | 3.37 | 13 |
| 36 | CCGGCG | 17 | 4 | 3.33 | 12 |
| 37 | AGCCGG | 34 | 12 | 3.29 | 25 |
| 38 | GGAGCC | 67 | 34 | 3.27 | 40 |
| 39 | CCCCAG | 103 | 60 | 3.23 | 51 |
| 40 | CCGCTC | 24 | 7 | 3.19 | 19 |
| 41 | CCCCTC | 81 | 44 | 3.19 | 43 |
| 42 | CACCGC | 33 | 12 | 3.14 | 22 |
| 43 | CTGCCC | 96 | 55 | 3.01 | 42 |
| 44 | GGGCCA | 68 | 35 | 2.99 | 39 |
| 45 | CGCTGC | 28 | 9 | 2.88 | 22 |
| 46 | CAGCGC | 25 | 8 | 2.77 | 19 |
| 47 | CGGCCC | 28 | 10 | 2.73 | 19 |
| 48 | CCGCCG | 19 | 5 | 2.56 | 9 |
| 49 | CCCCGG | 30 | 11 | 2.41 | 17 |
| 50 | AGCCGC | 23 | 7 | 2.34 | 17 |
| 51 | GCACCC | 55 | 27 | 2.31 | 38 |
| 52 | AGGACC | 54 | 27 | 2.22 | 33 |
| 53 | AGGGCG | 24 | 8 | 2.2 | 18 |
| 54 | CAGGGC | 81 | 47 | 2.18 | 42 |
| 55 | CCCGCC | 45 | 21 | 2.15 | 20 |
| 56 | GCCAGC | 66 | 36 | 2.09 | 39 |
| 57 | AGCGCC | 21 | 6 | 2.09 | 18 |
| 58 | AGGCCC | 64 | 34 | 2.08 | 32 |
| 59 | CCCACC | 101 | 62 | 2.05 | 54 |
| 60 | CGCTCA | 21 | 6 | 2.03 | 17 |
| 61 | AACGCG | 9 | 1 | 1.96 | 9 |
| 62 | GCGGCA | 21 | 7 | 1.92 | 14 |
| 63 | AGGTCC | 49 | 24 | 1.87 | 36 |
| 64 | CCGTCA | 19 | 6 | 1.78 | 14 |
| 65 | CAGAGG | 107 | 68 | 1.77 | 47 |
| 66 | CCCGAG | 33 | 14 | 1.77 | 22 |
| 67 | CCGAGG | 36 | 16 | 1.76 | 25 |
| 68 | CGCGGA | 11 | 2 | 1.75 | 8 |
| 69 | CCACCC | 87 | 53 | 1.71 | 45 |
| 70 | CCTCGC | 23 | 8 | 1.71 | 20 |
| 71 | CAAGCC | 59 | 32 | 1.69 | 40 |
| 72 | TCCGCA | 18 | 5 | 1.68 | 17 |
| 73 | CGCCGC | 18 | 5 | 1.67 | 9 |
| 74 | GGGAAC | 55 | 29 | 1.63 | 39 |
| 75 | CCAGAG | 93 | 58 | 1.57 | 49 |
| 76 | CGTTCC | 19 | 6 | 1.53 | 16 |
| 77 | CGAGGA | 23 | 8 | 1.5 | 19 |
| 78 | GGGACC | 48 | 24 | 1.48 | 31 |
| 79 | CCGCGA | 10 | 2 | 1.48 | 8 |
| 80 | CCTGCG | 24 | 9 | 1.45 | 17 |
| 81 | CTGCGC | 23 | 8 | 1.32 | 14 |
| 82 | GACCCC | 47 | 24 | 1.31 | 33 |
| 83 | GCTCCA | 66 | 38 | 1.25 | 39 |
| 84 | CGCCAC | 33 | 15 | 1.19 | 21 |
| 85 | GCGGGA | 23 | 9 | 1.17 | 18 |
| 86 | CTGCGA | 18 | 6 | 1.15 | 15 |
| 87 | CTGCTC | 80 | 49 | 1.14 | 50 |
| 88 | CAGACG | 23 | 9 | 1.13 | 19 |
| 89 | CGAGAG | 21 | 8 | 1.09 | 17 |
| 90 | CGGTGC | 18 | 6 | 1.06 | 16 |
| 91 | CTCCCC | 84 | 53 | 1.05 | 47 |
| 92 | GCGGCC | 22 | 8 | 1.04 | 14 |
| 93 | CGGCGC | 14 | 4 | 1.04 | 13 |
| 94 | AAGCCC* | 60 | 34 | 1.03 | 42 |
| 95 | CCGCAG | 24 | 9 | 1.03 | 17 |
| 96 | GCCCAC | 59 | 34 | 0.95 | 35 |
| 97 | CACCCA | 92 | 60 | 0.93 | 49 |
| 98 | GCGCCC | 27 | 11 | 0.93 | 18 |
| 99 | ACCGGC | 15 | 4 | 0.92 | 13 |
| 100 | CTCGCA | 16 | 5 | 0.89 | 14 |
| 101 | ACGCTC | 16 | 5 | 0.88 | 12 |
| 102 | CTGGAC | 58 | 33 | 0.88 | 32 |
| 103 | GCCCCA | 67 | 40 | 0.87 | 38 |
| 104 | ACCGTC | 15 | 4 | 0.86 | 11 |
| 105 | CCCTCG | 21 | 8 | 0.8 | 18 |
| 106 | AGCCCG | 22 | 8 | 0.79 | 14 |
| 107 | ACCCGA | 16 | 5 | 0.78 | 13 |
| 108 | AGCAGC | 79 | 50 | 0.75 | 41 |
| 109 | ACCGCG | 14 | 4 | 0.69 | 7 |
| 110 | CGAGGC | 29 | 13 | 0.69 | 24 |
| 111 | AGCTGC | 70 | 43 | 0.64 | 36 |
| 112 | GGGGAC | 49 | 27 | 0.64 | 34 |
| 113 | CCGCAA | 16 | 5 | 0.64 | 12 |
| 114 | CGTCGC | 8 | 1 | 0.62 | 6 |
| 115 | CGTGAC | 17 | 6 | 0.57 | 15 |
| 116 | CGCCCA | 33 | 16 | 0.56 | 22 |
| 117 | CTCTGC | 97 | 65 | 0.54 | 47 |
| 118 | AGCGGG | 21 | 8 | 0.52 | 17 |
| 119 | ACCGCT | 15 | 5 | 0.5 | 11 |
| 120 | CCCAGG | 133 | 95 | 0.49 | 58 |
| 121 | CCCTCA | 71 | 45 | 0.49 | 39 |
| 122 | CCCCCA* | 77 | 49 | 0.49 | 42 |
| 123 | GGCGAA | 16 | 5 | 0.48 | 14 |
| 124 | CGGCTC | 29 | 13 | 0.47 | 19 |
| 125 | CTCGCC | 20 | 8 | 0.46 | 17 |
| 126 | CGGAGA | 20 | 8 | 0.45 | 14 |
| 127 | TCCCCA | 95 | 64 | 0.43 | 52 |
| 128 | GACACC | 44 | 24 | 0.42 | 33 |
| 129 | CTCCGA | 17 | 6 | 0.42 | 13 |
| 130 | CTCGTC | 17 | 6 | 0.42 | 14 |
| 131 | CGACCA | 13 | 4 | 0.39 | 11 |
| 132 | ATGACG | 17 | 6 | 0.37 | 12 |
| 133 | CCATCG | 17 | 6 | 0.37 | 13 |
| 134 | AGGGGA | 78 | 51 | 0.36 | 44 |
| 135 | GCTGCA | 77 | 50 | 0.35 | 43 |
| 136 | ACCCCA | 76 | 49 | 0.33 | 40 |
| 137 | CGGAGC | 21 | 9 | 0.33 | 16 |
| 138 | CCTCCG | 28 | 13 | 0.32 | 19 |
| 139 | CGGGAC | 16 | 6 | 0.3 | 10 |
| 140 | CCTGGA | 88 | 59 | 0.3 | 45 |
| 141 | AGGCGA | 18 | 7 | 0.29 | 17 |
| 142 | ACCCCT | 54 | 32 | 0.28 | 36 |
| 143 | GCTCCC | 56 | 34 | 0.27 | 36 |
| 144 | CGTCAC | 16 | 6 | 0.27 | 15 |
| 145 | AGCGCA | 16 | 6 | 0.26 | 11 |
| 146 | GAAGCC | 62 | 38 | 0.25 | 39 |
| 147 | GAGGCC | 79 | 52 | 0.22 | 42 |
| 148 | ACCCTC | 54 | 32 | 0.22 | 33 |
| 149 | CCCGGC | 37 | 20 | 0.21 | 21 |
| 150 | CGAGAA | 20 | 8 | 0.2 | 17 |
| 151 | CCACCG | 29 | 14 | 0.18 | 20 |
| 152 | ACTTCG | 16 | 6 | 0.17 | 14 |
| 153 | GATGAC | 48 | 28 | 0.17 | 35 |
| 154 | ACGAGG | 23 | 10 | 0.16 | 18 |
| 155 | CCGGAG | 20 | 8 | 0.15 | 18 |
| 156 | ACCCAC | 60 | 37 | 0.12 | 41 |
| 157 | CTGGGC | 105 | 74 | 0.11 | 50 |
| 158 | CCACGG | 23 | 10 | 0.09 | 19 |

TABLE 9-continued

Oligonucleotide patterns (6 base pairs) over-represented in STAR elements. The patterns are ranked according to significance coefficient. These were determined using RSA-Tools with the sequence of the human genome as reference. Patterns that comprise the most discriminant variables in Linear Discriminant Analysis are indicated with an asterisk.

| Number | Oligonucleotide sequence | Observed occurrences | Expected occurrences | Significance coefficient | Number of matching STARs |
|---|---|---|---|---|---|
| 159 | CGGTCC | 13 | 4 | 0.09 | 12 |
| 160 | AGCACC* | 54 | 33 | 0.09 | 40 |
| 161 | ACACCC | 53 | 32 | 0.08 | 38 |
| 162 | AGGGCC | 54 | 33 | 0.08 | 30 |
| 163 | CGCGAA | 6 | 1 | 0.02 | 6 |
| 164 | GAGCCC | 58 | 36 | 0.02 | 36 |
| 165 | CTGAGC | 71 | 46 | 0.02 | 45 |
| 166 | AATCGG | 13 | 4 | 0.02 | 11 |

TABLE 10

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk.

| Number | Dyad sequence | Observed occurrences | Expected occurrences | Significance coefficient |
|---|---|---|---|---|
| 1 | CCCN{2}CGG (SEQ ID NO:350) | 36 | 7 | 9.31 |
| 2 | CCGN{6}CCC (SEQ ID NO:351) | 40 | 10 | 7.3 |
| 3 | CAGN{0}CGG (SEQ ID NO:352) | 36 | 8 | 7.13 |
| 4 | CGCN{15}CCC (SEQ ID NO:353) | 34 | 8 | 6.88 |
| 5 | CGGN{9}GCC (SEQ ID NO:354) | 33 | 7 | 6.82 |
| 6 | CCCN{9}CGC (SEQ ID NO:355) | 35 | 8 | 6.72 |
| 7 | CCCN{1}GCG (SEQ ID NO:356) | 34 | 8 | 6.64 |
| 8 | CCCN{0}CAC (SEQ ID NO:357) | 103 | 48 | 6.61 |
| 9 | AGCN{16}CCG (SEQ ID NO:358) | 29 | 6 | 5.96 |
| 10 | CCCN{4}CGC (SEQ ID NO:359) | 34 | 8 | 5.8 |
| 11 | CGCN{13}GGA (SEQ ID NO:360) | 26 | 5 | 5.77 |
| 12 | GCGN{16}CCC (SEQ ID NO:361) | 30 | 7 | 5.74 |
| 13 | CGCN{5}GCA (SEQ ID NO:362) | 25 | 5 | 5.49 |
| 14 | CCCN{14}CCC (SEQ ID NO:363) | 101 | 49 | 5.43 |
| 15 | CTGN{4}CGC (SEQ ID NO:364) | 34 | 9 | 5.41 |
| 16 | CCAN{12}GCG (SEQ ID NO:365) | 28 | 6 | 5.37 |
| 17 | CGGN{11}CAG (SEQ ID NO:366) | 36 | 10 | 5.25 |
| 18 | CCCN{5}GCC (SEQ ID NO:367) | 75 | 33 | 4.87 |
| 19 | GCCN{0}CCC (SEQ ID NO:368) | 64 | 26 | 4.81 |
| 20 | CGCN{4}GAC (SEQ ID NO:369) | 19 | 3 | 4.78 |
| 21 | CGGN{0}CAG (SEQ ID NO:370) | 33 | 9 | 4.76 |
| 22 | CCCN{3}CGC (SEQ ID NO:371) | 32 | 8 | 4.67 |
| 23 | CGCN{1}GAC (SEQ ID NO:372) | 20 | 3 | 4.58 |
| 24 | GCGN{2}GCC (SEQ ID NO:373) | 29 | 7 | 4.54 |
| 25 | CCCN{4}GCC (SEQ ID NO:374) | 76 | 34 | 4.53 |
| 26 | CCCN{1}CCC (SEQ ID NO:375) | 103 | 52 | 4.53 |
| 27 | CCGN{13}CAG (SEQ ID NO:376) | 33 | 9 | 4.5 |
| 28 | GCCN{4}GGA (SEQ ID NO:377) | 64 | 27 | 4.48 |
| 29 | CCGN{3}GGA (SEQ ID NO:378) | 26 | 6 | 4.46 |
| 30 | AGGN{2}GGG (SEQ ID NO:379) | 118 | 63 | 4.44 |
| 31 | CACN{5}GCG (SEQ ID NO:380) | 22 | 4 | 4.42 |
| 32 | CGCN{17}CCA (SEQ ID NO:381) | 27 | 6 | 4.39 |
| 33 | CCCN{9}GGC (SEQ ID NO:382) | 69 | 30 | 4.38 |
| 34 | CCTN{5}GCG (SEQ ID NO:383) | 28 | 7 | 4.37 |
| 35 | GCGN{0}GAC (SEQ ID NO:384) | 19 | 3 | 4.32 |
| 36 | GCCN{0}GGC (SEQ ID NO:385) | 40 | 7 | 4.28 |
| 37 | GCGN{2}CCC (SEQ ID NO:386) | 26 | 6 | 4.27 |

TABLE 10-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk.

| Number | Dyad sequence | Observed occurrences | Expected occurrences | Significance coefficient |
|---|---|---|---|---|
| 38 | CCGN{11}CCC (SEQ ID NO:387) | 32 | 9 | 4.17 |
| 39 | CCCN{8}TCG (SEQ ID NO:388) | 23 | 5 | 4.12 |
| 40 | CCGN{17}GCC (SEQ ID NO:389) | 30 | 8 | 4.12 |
| 41 | GGGN{5}GGA (SEQ ID NO:390) | 101 | 52 | 4.11 |
| 42 | GGCN{6}GGA (SEQ ID NO:391) | 71 | 32 | 4.1 |
| 43 | CCAN{4}CCC (SEQ ID NO:392) | 96 | 48 | 4.1 |
| 44 | CCTN{14}CCG (SEQ ID NO:393) | 32 | 9 | 4.09 |
| 45 | GACN{12}GGC (SEQ ID NO:394) | 45 | 16 | 4.07 |
| 46 | CGCN{13}CCC (SEQ ID NO:395) | 30 | 8 | 4.04 |
| 47 | CAGN{16}CCC (SEQ ID NO:396) | 92 | 46 | 4.02 |
| 48 | AGCN{10}GGG (SEQ ID NO:397) | 75 | 35 | 3.94 |
| 49 | CGGN{13}GGC (SEQ ID NO:398) | 30 | 8 | 3.93 |
| 50 | CGGN{1}GCC (SEQ ID NO:399) | 30 | 8 | 3.92 |
| 51 | AGCN{0}GGC (SEQ ID NO:400) | 26 | 6 | 3.9 |
| 52 | CCCN{16}GGC (SEQ ID NO:401) | 64 | 28 | 3.89 |
| 53 | GCTN{19}CCC (SEQ ID NO:402) | 67 | 29 | 3.87 |
| 54 | CCCN{16}GGG (SEQ ID NO:403) | 88 | 31 | 3.81 |
| 55 | CCCN{9}CGG (SEQ ID NO:404) | 30 | 8 | 3.77 |
| 56 | CCCN{10}CGG (SEQ ID NO:405) | 30 | 8 | 3.76 |
| 57 | CCAN{0}CGC (SEQ ID NO:406) | 32 | 9 | 3.75 |
| 58 | GCCN{17}CGC (SEQ ID NO:407) | 26 | 6 | 3.74 |
| 59 | CCTN{6}CGC (SEQ ID NO:408) | 27 | 7 | 3.73 |
| 60 | GGAN{1}CCC (SEQ ID NO:409) | 63 | 27 | 3.71 |
| 61 | CGCN{18}CAC (SEQ ID NO:410) | 24 | 5 | 3.7 |
| 62 | CGCN{20}CCG (SEQ ID NO:411) | 21 | 4 | 3.69 |
| 63 | CCGN{0}GCA (SEQ ID NO:412) | 26 | 6 | 3.69 |
| 64 | CGCN{20}CCC (SEQ ID NO:413) | 28 | 7 | 3.69 |
| 65 | AGCN{15}CCC (SEQ ID NO:414) | 67 | 30 | 3.65 |
| 66 | CCTN{7}GGC (SEQ ID NO:415) | 69 | 31 | 3.63 |
| 67 | GCCN{5}CGC (SEQ ID NO:416) | 32 | 9 | 3.61 |
| 68 | GCCN{14}CGC (SEQ ID NO:417) | 28 | 7 | 3.59 |
| 69 | CAGN{11}CCC (SEQ ID NO:418) | 89 | 45 | 3.58 |
| 70 | GGGN{16}GAC (SEQ ID NO:419) | 53 | 21 | 3.57 |
| 71 | CCCN{15}GCG (SEQ ID NO:420) | 25 | 6 | 3.57 |
| 72 | CCCN{0}CGC (SEQ ID NO:421) | 37 | 12 | 3.54 |
| 73 | CCCN{16}AGC* (SEQ ID NO:422) | 67 | 30 | 3.54 |
| 74 | AGGN{9}GGG (SEQ ID NO:423) | 96 | 50 | 3.52 |
| 75 | CGCN{12}CTC (SEQ ID NO:424) | 28 | 7 | 3.46 |
| 76 | CACN{8}CGC (SEQ ID NO:425) | 23 | 5 | 3.43 |
| 77 | CCAN{7}CCG (SEQ ID NO:426) | 31 | 9 | 3.42 |
| 78 | CGGN{1}GCA (SEQ ID NO:427) | 25 | 6 | 3.41 |
| 79 | CGCN{14}CCC (SEQ ID NO:428) | 29 | 8 | 3.4 |
| 80 | AGCN{0}CCC (SEQ ID NO:429) | 76 | 36 | 3.4 |
| 81 | CGCN{13}GTC (SEQ ID NO:430) | 18 | 3 | 3.37 |
| 82 | GCGN{3}GCA (SEQ ID NO:431) | 26 | 7 | 3.35 |
| 83 | CGGN{0}GGC (SEQ ID NO:432) | 34 | 11 | 3.35 |

TABLE 10-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk.

| Number | Dyad sequence | Observed occurrences | Expected occurrences | Significance coefficient |
|---|---|---|---|---|
| 84 (SEQ ID NO:433) | GCCN{14}CCC | 68 | 31 | 3.33 |
| 85 (SEQ ID NO:434) | ACCN{7}CGC | 21 | 4 | 3.32 |
| 86 (SEQ ID NO:435) | AGGN{7}CGG | 33 | 10 | 3.31 |
| 87 (SEQ ID NO:436) | CCCN{16}CGA | 22 | 5 | 3.3 |
| 88 (SEQ ID NO:437) | CGCN{6}CAG | 31 | 9 | 3.29 |
| 89 (SEQ ID NO:438) | CAGN{11}GCG | 29 | 8 | 3.29 |
| 90 (SEQ ID NO:439) | CCGN{12}CCG | 19 | 4 | 3.26 |
| 91 (SEQ ID NO:440) | CGCN{18}CAG | 27 | 7 | 3.24 |
| 92 (SEQ ID NO:441) | CAGN{1}GGG | 80 | 39 | 3.21 |
| 93 (SEQ ID NO:442) | CGCN{0}CCC | 32 | 10 | 3.2 |
| 94 (SEQ ID NO:443) | GCGN{18}GCC | 26 | 7 | 3.18 |
| 95 (SEQ ID NO:444) | CGGN{15}GGC | 27 | 7 | 3.15 |
| 96 (SEQ ID NO:445) | CCCN{15}AGG | 72 | 34 | 3.14 |
| 97 (SEQ ID NO:446) | AGGN{20}GCG | 26 | 7 | 3.14 |
| 98 (SEQ ID NO:447) | CGGN{5}CTC | 26 | 7 | 3.13 |
| 99 (SEQ ID NO:448) | TCCN{17}CGA | 23 | 5 | 3.12 |
| 100 (SEQ ID NO:449) | GCGN{4}CCC | 30 | 9 | 3.08 |
| 101 (SEQ ID NO:450) | CCCN{2}CGC | 30 | 9 | 3.07 |
| 102 (SEQ ID NO:451) | CGTN{3}CAG | 28 | 8 | 3.06 |
| 103 (SEQ ID NO:452) | CCGN{13}GAG | 27 | 7 | 3.05 |
| 104 (SEQ ID NO:453) | CTCN{6}CGC | 28 | 8 | 3.04 |
| 105 (SEQ ID NO:454) | CGCN{4}GAG | 21 | 5 | 3.03 |
| 106 (SEQ ID NO:455) | GCGN{5}GGA | 24 | 6 | 3.03 |
| 107 (SEQ ID NO:456) | CCGN{1}CAG | 27 | 7 | 3.01 |
| 108 (SEQ ID NO:457) | CGCN{11}CCG | 18 | 3 | 2.99 |
| 109 (SEQ ID NO:458) | GCGN{19}CCC | 26 | 7 | 2.98 |
| 110 (SEQ ID NO:459) | CGCN{18}GAA | 21 | 5 | 2.98 |
| 111 (SEQ ID NO:460) | GGGN{19}GGA | 78 | 39 | 2.95 |
| 112 (SEQ ID NO:461) | CCAN{1}CGG | 24 | 6 | 2.94 |
| 113 (SEQ ID NO:462) | CCCN{7}GCG | 25 | 6 | 2.94 |
| 114 (SEQ ID NO:463) | AGGN{10}CCC | 84 | 43 | 2.92 |
| 115 (SEQ ID NO:464) | CCAN{0}GGG | 97 | 52 | 2.88 |
| 116 (SEQ ID NO:465) | CAGN{10}CCC | 82 | 41 | 2.87 |
| 117 (SEQ ID NO:466) | CCGN{18}CCG | 19 | 4 | 2.86 |
| 118 (SEQ ID NO:467) | CCGN{18}GGC | 26 | 7 | 2.85 |
| 119 (SEQ ID NO:468) | CCCN{2}GCG | 24 | 6 | 2.84 |
| 120 (SEQ ID NO:469) | CGCN{1}GGC | 25 | 7 | 2.83 |
| 121 (SEQ ID NO:470) | CCGN{5}GAC | 19 | 4 | 2.81 |
| 122 (SEQ ID NO:471) | GGAN{0}CCC | 52 | 22 | 2.8 |
| 123 (SEQ ID NO:472) | CCCN{1}CCG | 29 | 9 | 2.78 |
| 124 (SEQ ID NO:473) | CCCN{15}ACG | 23 | 6 | 2.75 |
| 125 (SEQ ID NO:474) | AGCN{8}CCC | 66 | 31 | 2.73 |
| 126 (SEQ ID NO:475) | CCCN{3}GGC | 60 | 27 | 2.71 |
| 127 (SEQ ID NO:476) | AGGN{9}CGG | 31 | 10 | 2.7 |
| 128 (SEQ ID NO:477) | CCCN{14}CGC | 27 | 8 | 2.7 |
| 129 (SEQ ID NO:478) | CCGN{0}CCG | 19 | 4 | 2.7 |

TABLE 10-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk.

| Number | Dyad sequence | Observed occurrences | Expected occurrences | Significance coefficient |
|---|---|---|---|---|
| 130 | CGCN{8}AGC (SEQ ID NO:479) | 23 | 6 | 2.69 |
| 131 | CGCN{19}ACC (SEQ ID NO:480) | 21 | 5 | 2.68 |
| 132 | GCGN{17}GAC (SEQ ID NO:481) | 17 | 3 | 2.66 |
| 133 | AGCN{1}GCG (SEQ ID NO:482) | 24 | 6 | 2.63 |
| 134 | CCGN{11}GGC (SEQ ID NO:483) | 31 | 10 | 2.63 |
| 135 | CGGN{4}AGA (SEQ ID NO:484) | 26 | 7 | 2.63 |
| 136 | CGCN{14}CCG (SEQ ID NO:485) | 17 | 3 | 2.62 |
| 137 | CCTN{20}GCG (SEQ ID NO:486) | 24 | 6 | 2.62 |
| 138 | CCAN{10}CGC (SEQ ID NO:487) | 26 | 7 | 2.61 |
| 139 | CCCN{20}CAC (SEQ ID NO:488) | 69 | 33 | 2.6 |
| 140 | CCGN{11}GCC (SEQ ID NO:489) | 27 | 8 | 2.6 |
| 141 | CGCN{18}CCC (SEQ ID NO:490) | 26 | 7 | 2.59 |
| 142 | CGGN{15}CGC (SEQ ID NO:491) | 16 | 3 | 2.57 |
| 143 | CGCN{16}GCC (SEQ ID NO:492) | 24 | 6 | 2.55 |
| 144 | CGCN{20}GGC (SEQ ID NO:493) | 23 | 6 | 2.54 |
| 145 | CGCN{19}CCG (SEQ ID NO:494) | 18 | 4 | 2.52 |
| 146 | CGGN{10}CCA (SEQ ID NO:495) | 28 | 8 | 2.51 |
| 147 | CGCN{17}CCC (SEQ ID NO:496) | 26 | 7 | 2.51 |
| 148 | CGCN{11}ACA (SEQ ID NO:497) | 23 | 6 | 2.51 |
| 149 | CGGN{0}ACC (SEQ ID NO:498) | 17 | 3 | 2.5 |
| 150 | GCGN{10}GCC (SEQ ID NO:499) | 24 | 6 | 2.49 |
| 151 | GCGN{8}GAC (SEQ ID NO:500) | 17 | 3 | 2.49 |
| 152 | CCCN{15}GGG (SEQ ID NO:501) | 84 | 32 | 2.44 |
| 153 | CGGN{16}GGC (SEQ ID NO:502) | 27 | 8 | 2.44 |
| 154 | CGCN{16}CCA (SEQ ID NO:503) | 23 | 6 | 2.42 |
| 155 | GCCN{3}CCC (SEQ ID NO:504) | 73 | 36 | 2.4 |
| 156 | CAGN{4}GGG (SEQ ID NO:505) | 94 | 51 | 2.4 |
| 157 | CCCN{6}GCG (SEQ ID NO:506) | 23 | 6 | 2.38 |
| 158 | CCGN{16}CGC (SEQ ID NO:507) | 17 | 3 | 2.38 |
| 159 | CCCN{17}GCA (SEQ ID NO:508) | 61 | 28 | 2.37 |
| 160 | CGCN{13}TCC (SEQ ID NO:509) | 24 | 6 | 2.37 |
| 161 | GCCN{1}CGC (SEQ ID NO:510) | 29 | 9 | 2.36 |
| 162 | CCGN{19}GAG (SEQ ID NO:511) | 26 | 7 | 2.35 |
| 163 | GGGN{10}GGA (SEQ ID NO:512) | 89 | 48 | 2.35 |
| 164 | CAGN{5}CCG (SEQ ID NO:513) | 32 | 11 | 2.35 |
| 165 | CGCN{3}AGA (SEQ ID NO:514) | 19 | 4 | 2.32 |
| 166 | GCCN{0}GCC (SEQ ID NO:515) | 29 | 9 | 2.32 |
| 167 | CCCN{8}GGC (SEQ ID NO:516) | 61 | 28 | 2.31 |
| 168 | CCTN{6}GCG (SEQ ID NO:517) | 22 | 6 | 2.29 |
| 169 | GACN{6}CCC (SEQ ID NO:518) | 48 | 20 | 2.29 |
| 170 | CGGN{1}CCC (SEQ ID NO:519) | 26 | 8 | 2.27 |
| 171 | CCCN{15}CCG (SEQ ID NO:520) | 30 | 10 | 2.27 |
| 172 | CAGN{9}CCC (SEQ ID NO:521) | 84 | 44 | 2.26 |
| 173 | CGGN{10}GGC (SEQ ID NO:522) | 27 | 8 | 2.26 |
| 174 | CGAN{10}ACG (SEQ ID NO:523) | 10 | 1 | 2.26 |
| 175 | GCGN{3}TCC (SEQ ID NO:524) | 21 | 5 | 2.26 |

TABLE 10-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk.

| Number | Dyad sequence | Observed occurrences | Expected occurrences | Significance coefficient |
|---|---|---|---|---|
| 176 | CCCN{3}GCC (SEQ ID NO:525) | 75 | 38 | 2.24 |
| 177 | GCGN{1}ACC (SEQ ID NO:526) | 17 | 3 | 2.24 |
| 178 | CCGN{9}AGG (SEQ ID NO:527) | 27 | 8 | 2.23 |
| 179 | CGCN{16}CAG (SEQ ID NO:528) | 26 | 8 | 2.23 |
| 180 | GGCN{0}CCC (SEQ ID NO:529) | 62 | 29 | 2.22 |
| 181 | AGGN{12}CCG (SEQ ID NO:530) | 26 | 8 | 2.19 |
| 182 | CCGN{0}GCG (SEQ ID NO:531) | 16 | 3 | 2.19 |
| 183 | CCGN{2}GCC (SEQ ID NO:532) | 30 | 10 | 2.18 |
| 184 | CCGN{11}GTC (SEQ ID NO:533) | 19 | 4 | 2.17 |
| 185 | CAGN{0}CCC (SEQ ID NO:534) | 88 | 47 | 2.17 |
| 186 | CCCN{5}CCG (SEQ ID NO:535) | 32 | 11 | 2.17 |
| 187 | GCCN{20}CCC (SEQ ID NO:536) | 66 | 32 | 2.15 |
| 188 | GACN{2}CGC (SEQ ID NO:537) | 18 | 4 | 2.14 |
| 189 | CGCN{6}CAC (SEQ ID NO:538) | 23 | 6 | 2.13 |
| 190 | AGGN{14}GCG (SEQ ID NO:539) | 25 | 7 | 2.1 |
| 191 | GACN{5}CGC (SEQ ID NO:540) | 17 | 3 | 2.1 |
| 192 | CCTN{19}CCG (SEQ ID NO:541) | 29 | 9 | 2.1 |
| 193 | CCGN{12}GGA (SEQ ID NO:542) | 24 | 7 | 2.08 |
| 194 | GGCN{9}GAC* (SEQ ID NO:543) | 44 | 18 | 2.08 |
| 195 | AGGN{10}GGG (SEQ ID NO:544) | 94 | 52 | 2.07 |
| 196 | CCGN{10}GAG (SEQ ID NO:545) | 25 | 7 | 2.07 |
| 197 | CGCN{6}GGA (SEQ ID NO:546) | 20 | 5 | 2.06 |
| 198 | CGCN{7}AGC (SEQ ID NO:547) | 23 | 6 | 2.04 |
| 199 | CCAN{13}CGG (SEQ ID NO:548) | 26 | 8 | 2.03 |
| 200 | CGGN{6}GGA (SEQ ID NO:549) | 25 | 7 | 2.03 |
| 201 | CGCN{19}GCC (SEQ ID NO:550) | 24 | 7 | 2.03 |
| 202 | CCAN{12}CGC (SEQ ID NO:551) | 24 | 7 | 2.02 |
| 203 | CGGN{1}GGC (SEQ ID NO:552) | 41 | 16 | 2.02 |
| 204 | GCGN{3}CCA (SEQ ID NO:553) | 25 | 7 | 2.01 |
| 205 | AGGN{1}CGC (SEQ ID NO:554) | 21 | 5 | 2 |
| 206 | CTCN{5}CGC (SEQ ID NO:555) | 24 | 7 | 1.98 |
| 207 | CCCN{0}ACG (SEQ ID NO:556) | 30 | 10 | 1.97 |
| 208 | CAGN{17}CCG (SEQ ID NO:557) | 29 | 9 | 1.96 |
| 209 | GGCN{4}CCC (SEQ ID NO:558) | 62 | 30 | 1.96 |
| 210 | AGGN{8}GCG (SEQ ID NO:559) | 26 | 8 | 1.96 |
| 211 | CTGN{1}CCC (SEQ ID NO:560) | 88 | 48 | 1.94 |
| 212 | CCCN{16}CAG (SEQ ID NO:561) | 85 | 46 | 1.94 |
| 213 | CGCN{9}GAC (SEQ ID NO:562) | 16 | 3 | 1.93 |
| 214 | CAGN{6}CCG (SEQ ID NO:563) | 29 | 9 | 1.92 |
| 215 | CGTN{12}CGC (SEQ ID NO:564) | 11 | 1 | 1.92 |
| 216 | CTCN{7}GCC (SEQ ID NO:565) | 69 | 35 | 1.92 |
| 217 | CGCN{19}TCC (SEQ ID NO:566) | 22 | 6 | 1.92 |
| 218 | CCCN{7}GCC (SEQ ID NO:567) | 67 | 33 | 1.91 |
| 219 | CAGN{13}CGG (SEQ ID NO:568) | 30 | 10 | 1.9 |
| 220 | CGCN{1}GCC (SEQ ID NO:569) | 27 | 8 | 1.9 |
| 221 | CGCN{17}CCG (SEQ ID NO:570) | 17 | 4 | 1.89 |

TABLE 10-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk.

| Number | Dyad sequence | Observed occurrences | Expected occurrences | Significance coefficient |
|---|---|---|---|---|
| 222 | AGGN{4}CCC (SEQ ID NO:571) | 63 | 31 | 1.89 |
| 223 | AGCN{10}CGC (SEQ ID NO:572) | 21 | 5 | 1.89 |
| 224 | CCCN{11}CGG (SEQ ID NO:573) | 30 | 10 | 1.88 |
| 225 | CCCN{8}GCC (SEQ ID NO:574) | 75 | 39 | 1.86 |
| 226 | CCGN{1}CGG (SEQ ID NO:575) | 22 | 3 | 1.86 |
| 227 | CCCN{1}ACC (SEQ ID NO:576) | 71 | 36 | 1.85 |
| 228 | CGCN{0}CAG (SEQ ID NO:577) | 25 | 7 | 1.85 |
| 229 | CCGN{19}TGC (SEQ ID NO:578) | 23 | 6 | 1.82 |
| 230 | GCGN{4}CGA (SEQ ID NO:579) | 12 | 2 | 1.82 |
| 231 | CCGN{19}GCC (SEQ ID NO:580) | 30 | 10 | 1.82 |
| 232 | CCAN{10}CCC (SEQ ID NO:581) | 85 | 46 | 1.81 |
| 233 | CAGN{13}GGG (SEQ ID NO:582) | 91 | 51 | 1.81 |
| 234 | AGCN{18}CGG (SEQ ID NO:583) | 23 | 6 | 1.81 |
| 235 | CGAN{8}CGC (SEQ ID NO:584) | 11 | 1 | 1.81 |
| 236 | AGCN{4}CCC (SEQ ID NO:585) | 63 | 31 | 1.8 |
| 237 | GGAN{6}CCC (SEQ ID NO:586) | 61 | 30 | 1.8 |
| 238 | CGGN{13}AAG (SEQ ID NO:587) | 23 | 6 | 1.8 |
| 239 | ACCN{11}CGC (SEQ ID NO:588) | 19 | 5 | 1.79 |
| 240 | CCGN{12}CAG (SEQ ID NO:589) | 28 | 9 | 1.78 |
| 241 | CCCN{12}GGG (SEQ ID NO:590) | 76 | 29 | 1.77 |
| 242 | CACN{17}ACG (SEQ ID NO:591) | 22 | 6 | 1.76 |
| 243 | CAGN{18}CCC (SEQ ID NO:592) | 82 | 44 | 1.76 |
| 244 | CGTN{10}GTC (SEQ ID NO:593) | 19 | 5 | 1.75 |
| 245 | CCCN{13}GCG (SEQ ID NO:594) | 23 | 6 | 1.75 |
| 246 | GCAN{1}CGC (SEQ ID NO:595) | 20 | 5 | 1.73 |
| 247 | AGAN{4}CCG (SEQ ID NO:596) | 24 | 7 | 1.73 |
| 248 | GCGN{10}AGC (SEQ ID NO:597) | 22 | 6 | 1.72 |
| 249 | CGCN{0}GGA (SEQ ID NO:598) | 12 | 2 | 1.72 |
| 250 | CGGN{4}GAC (SEQ ID NO:599) | 17 | 4 | 1.69 |
| 251 | CCCN{12}CGC (SEQ ID NO:600) | 26 | 8 | 1.68 |
| 252 | GCCN{15}CCC (SEQ ID NO:601) | 65 | 33 | 1.68 |
| 253 | GCGN{6}TCC (SEQ ID NO:602) | 20 | 5 | 1.66 |
| 254 | CGGN{3}CAG (SEQ ID NO:603) | 33 | 12 | 1.65 |
| 255 | CCCN{3}CCA (SEQ ID NO:604) | 88 | 49 | 1.65 |
| 256 | AGCN{3}CCC (SEQ ID NO:605) | 59 | 28 | 1.65 |
| 257 | GGGN{16}GCA (SEQ ID NO:606) | 65 | 33 | 1.65 |
| 258 | AGGN{8}CCG (SEQ ID NO:607) | 28 | 9 | 1.64 |
| 259 | CCCN{0}CCG (SEQ ID NO:608) | 29 | 10 | 1.64 |
| 260 | GCGN{5}GAC (SEQ ID NO:609) | 16 | 3 | 1.64 |
| 261 | CCCN{9}ACC (SEQ ID NO:610) | 60 | 29 | 1.64 |
| 262 | CTGN{5}CGC (SEQ ID NO:611) | 25 | 8 | 1.64 |
| 263 | CGCN{14}CTC (SEQ ID NO:612) | 23 | 7 | 1.64 |
| 264 | CGGN{14}GCA (SEQ ID NO:613) | 23 | 7 | 1.63 |
| 265 | CCGN{8}GCC (SEQ ID NO:614) | 26 | 8 | 1.62 |
| 266 | CCGN{7}CAC (SEQ ID NO:615) | 23 | 7 | 1.62 |
| 267 | AGCN{8}GCG (SEQ ID NO:616) | 21 | 6 | 1.61 |

TABLE 10-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk.

| Number | Dyad sequence | Observed occurrences | Expected occurrences | Significance coefficient |
|---|---|---|---|---|
| 268 (SEQ ID NO:617) | CGGN{16}GGA | 29 | 10 | 1.61 |
| 269 (SEQ ID NO:618) | CCAN{12}CCG | 26 | 8 | 1.61 |
| 270 (SEQ ID NO:619) | CGGN{2}CCC | 26 | 8 | 1.6 |
| 271 (SEQ ID NO:620) | CCAN{13}GGG | 71 | 37 | 1.6 |
| 272 (SEQ ID NO:621) | CGGN{15}GCA | 21 | 6 | 1.6 |
| 273 (SEQ ID NO:622) | CGCN{9}GCA | 20 | 5 | 1.58 |
| 274 (SEQ ID NO:623) | CGGN{19}CCA | 26 | 8 | 1.58 |
| 275 (SEQ ID NO:624) | GGGN{15}CGA | 20 | 5 | 1.57 |
| 276 (SEQ ID NO:625) | CCCN{10}CGC | 26 | 8 | 1.57 |
| 277 (SEQ ID NO:626) | CTCN{14}CGC | 26 | 8 | 1.55 |
| 278 (SEQ ID NO:627) | CACN{11}GCG | 20 | 5 | 1.55 |
| 279 (SEQ ID NO:628) | CCGN{2}GGC | 24 | 7 | 1.55 |
| 280 (SEQ ID NO:629) | CTGN{18}CCC | 85 | 47 | 1.54 |
| 281 (SEQ ID NO:630) | GGGN{13}CAC | 58 | 28 | 1.54 |
| 282 (SEQ ID NO:631) | CCTN{15}GGC | 62 | 31 | 1.54 |
| 283 (SEQ ID NO:632) | CCCN{20}CGA | 20 | 5 | 1.54 |
| 284 (SEQ ID NO:633) | CCCN{8}CGA | 20 | 5 | 1.53 |
| 285 (SEQ ID NO:634) | GAGN{7}CCC | 61 | 30 | 1.53 |
| 286 (SEQ ID NO:635) | CGCN{2}CCG | 22 | 6 | 1.53 |
| 287 (SEQ ID NO:636) | CCCN{0}TCC | 98 | 57 | 1.52 |
| 288 (SEQ ID NO:637) | AGCN{0}GCC | 21 | 6 | 1.52 |
| 289 (SEQ ID NO:638) | CCCN{2}TCC | 82 | 45 | 1.52 |
| 290 (SEQ ID NO:639) | CCGN{5}CCC | 30 | 10 | 1.52 |
| 291 (SEQ ID NO:640) | CGCN{13}CGC | 16 | 3 | 1.51 |
| 292 (SEQ ID NO:641) | CCCN{1}CGC | 28 | 9 | 1.51 |
| 293 (SEQ ID NO:642) | GCCN{16}GCA | 53 | 25 | 1.51 |
| 294 (SEQ ID NO:643) | CCCN{16}CCA | 84 | 46 | 1.5 |
| 295 (SEQ ID NO:644) | CCGN{13}CGC | 19 | 5 | 1.5 |
| 296 (SEQ ID NO:645) | CCGN{17}CAG | 28 | 9 | 1.49 |
| 297 (SEQ ID NO:646) | CGGN{18}GGC | 26 | 8 | 1.49 |
| 298 (SEQ ID NO:647) | CCGN{14}AGG | 23 | 7 | 1.49 |
| 299 (SEQ ID NO:648) | CCCN{5}CGG | 26 | 8 | 1.49 |
| 300 (SEQ ID NO:649) | CCCN{6}GGA | 58 | 28 | 1.49 |
| 301 (SEQ ID NO:650) | ACGN{2}CCC | 20 | 5 | 1.49 |
| 302 (SEQ ID NO:651) | CCAN{9}CCG | 27 | 9 | 1.48 |
| 303 (SEQ ID NO:652) | CCCN{19}CCA | 78 | 42 | 1.48 |
| 304 (SEQ ID NO:653) | CAGN{0}GGG | 77 | 41 | 1.48 |
| 305 (SEQ ID NO:654) | AGCN{1}CCC | 58 | 28 | 1.47 |
| 306 (SEQ ID NO:655) | GCGN{7}TCC | 27 | 9 | 1.46 |
| 307 (SEQ ID NO:656) | ACGN{18}CCA | 25 | 8 | 1.46 |
| 308 (SEQ ID NO:657) | GCTN{14}CCC | 61 | 30 | 1.46 |
| 309 (SEQ ID NO:658) | GCGN{14}CCC | 23 | 7 | 1.46 |
| 310 (SEQ ID NO:659) | GCGN{19}AGC | 20 | 5 | 1.45 |
| 311 (SEQ ID NO:660) | CCGN{8}CAG | 29 | 10 | 1.45 |
| 312 (SEQ ID NO:661) | GCGN{6}GCC | 22 | 6 | 1.45 |
| 313 (SEQ ID NO:662) | GCGN{10}GCA | 20 | 5 | 1.44 |

TABLE 10-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk.

| Number | Dyad sequence | Observed occurrences | Expected occurrences | Significance coefficient |
|---|---|---|---|---|
| 314 (SEQ ID NO:663) | CCTN{7}GCC | 69 | 36 | 1.44 |
| 315 (SEQ ID NO:664) | GCCN{13}GCC | 54 | 26 | 1.42 |
| 316 (SEQ ID NO:665) | CCCN{14}GCC | 63 | 32 | 1.42 |
| 317 (SEQ ID NO:666) | CCCN{15}CGG | 26 | 8 | 1.42 |
| 318 (SEQ ID NO:667) | CCAN{13}CGC | 23 | 7 | 1.42 |
| 319 (SEQ ID NO:668) | AGCN{11}GGG | 67 | 35 | 1.41 |
| 320 (SEQ ID NO:669) | GGAN{0}GCC | 64 | 32 | 1.4 |
| 321 (SEQ ID NO:670) | GCCN{3}TCC | 61 | 30 | 1.4 |
| 322 (SEQ ID NO:671) | CCTN{5}GCC | 69 | 36 | 1.39 |
| 323 (SEQ ID NO:672) | CGGN{18}CCC | 25 | 8 | 1.39 |
| 324 (SEQ ID NO:673) | CCTN{3}GGC | 59 | 29 | 1.38 |
| 325 (SEQ ID NO:674) | CCGN{0}CTC | 22 | 6 | 1.38 |
| 326 (SEQ ID NO:675) | AGCN{17}GCG | 19 | 5 | 1.37 |
| 327 (SEQ ID NO:676) | ACGN{14}GGG | 20 | 5 | 1.37 |
| 328 (SEQ ID NO:677) | CGAN{12}GGC | 19 | 5 | 1.37 |
| 329 (SEQ ID NO:678) | CCCN{20}CGC | 24 | 7 | 1.37 |
| 330 (SEQ ID NO:679) | ACGN{12}CTG | 24 | 7 | 1.36 |
| 331 (SEQ ID NO:680) | CCGN{0}CCC | 36 | 14 | 1.36 |
| 332 (SEQ ID NO:681) | CCGN{10}GGA | 23 | 7 | 1.36 |
| 333 (SEQ ID NO:682) | CCCN{3}GCG | 21 | 6 | 1.36 |
| 334 (SEQ ID NO:683) | GCGN{14}CGC | 22 | 3 | 1.35 |
| 335 (SEQ ID NO:684) | CCGN{8}CGC | 16 | 4 | 1.35 |
| 336 (SEQ ID NO:685) | CGCN{10}ACA | 22 | 6 | 1.34 |
| 337 (SEQ ID NO:686) | CCCN{19}CCG | 28 | 10 | 1.33 |
| 338 (SEQ ID NO:687) | CACN{14}CGC | 20 | 5 | 1.32 |
| 339 (SEQ ID NO:688) | GACN{3}GGC | 46 | 21 | 1.32 |
| 340 (SEQ ID NO:689) | GAAN{7}CGC | 19 | 5 | 1.32 |
| 341 (SEQ ID NO:690) | CGCN{16}GGC | 21 | 6 | 1.31 |
| 342 (SEQ ID NO:691) | GGCN{9}CCC | 64 | 33 | 1.31 |
| 343 (SEQ ID NO:692) | CCCN{9}GCC | 64 | 33 | 1.31 |
| 344 (SEQ ID NO:693) | CGCN{0}TGC | 26 | 9 | 1.3 |
| 345 (SEQ ID NO:694) | CCTN{8}GGC | 67 | 35 | 1.3 |
| 346 (SEQ ID NO:695) | CCAN{8}CCC | 82 | 46 | 1.29 |
| 347 (SEQ ID NO:696) | GACN{2}CCC | 42 | 18 | 1.28 |
| 348 (SEQ ID NO:697) | GGCN{1}CCC | 54 | 26 | 1.27 |
| 349 (SEQ ID NO:698) | CGCN{0}AGC | 24 | 7 | 1.26 |
| 350 (SEQ ID NO:699) | AGGN{4}GCG | 28 | 10 | 1.26 |
| 351 (SEQ ID NO:700) | CGGN{6}TCC | 22 | 6 | 1.25 |
| 352 (SEQ ID NO:701) | ACGN{19}GGC | 20 | 5 | 1.25 |
| 353 (SEQ ID NO:702) | CCCN{8}ACG | 21 | 6 | 1.24 |
| 354 (SEQ ID NO:703) | CCCN{18}GCC | 62 | 31 | 1.24 |
| 355 (SEQ ID NO:704) | GCCN{2}CGA | 19 | 5 | 1.24 |
| 356 (SEQ ID NO:705) | CCCN{8}GCG | 28 | 10 | 1.23 |
| 357 (SEQ ID NO:706) | CCCN{0}CTC | 76 | 41 | 1.23 |
| 358 (SEQ ID NO:707) | GCCN{11}CGC | 27 | 9 | 1.22 |
| 359 (SEQ ID NO:708) | AGCN{9}CCC | 59 | 29 | 1.22 |

TABLE 10-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk.

| Number | Dyad sequence | Observed occurrences | Expected occurrences | Significance coefficient |
|---|---|---|---|---|
| 360 (SEQ ID NO:709) | GCTN{0}GCC | 71 | 38 | 1.21 |
| 361 (SEQ ID NO:710) | CGCN{3}CCC | 26 | 9 | 1.21 |
| 362 (SEQ ID NO:711) | CCCN{2}CCC | 117 | 72 | 1.19 |
| 363 (SEQ ID NO:712) | GCCN{9}CGC | 23 | 7 | 1.19 |
| 364 (SEQ ID NO:713) | GCAN{19}CGC | 19 | 5 | 1.19 |
| 365 (SEQ ID NO:714) | CAGN{4}CGG | 32 | 12 | 1.18 |
| 366 (SEQ ID NO:715) | CAGN{2}GGG | 80 | 44 | 1.17 |
| 367 (SEQ ID NO:716) | GCCN{16}CCC | 67 | 35 | 1.16 |
| 368 (SEQ ID NO:717) | GAGN{5}CCC | 60 | 30 | 1.16 |
| 369 (SEQ ID NO:718) | CCTN{16}TCG | 20 | 6 | 1.16 |
| 370 (SEQ ID NO:719) | CCCN{2}GGC | 62 | 32 | 1.15 |
| 371 (SEQ ID NO:720) | GCGN{13}GGA | 24 | 8 | 1.15 |
| 372 (SEQ ID NO:721) | GCCN{17}GGC | 66 | 25 | 1.15 |
| 373 (SEQ ID NO:722) | CCCN{14}GGC | 58 | 29 | 1.14 |
| 374 (SEQ ID NO:723) | AGGN{3}CCG | 31 | 12 | 1.14 |
| 375 (SEQ ID NO:724) | CACN{0}CGC | 32 | 12 | 1.14 |
| 376 (SEQ ID NO:725) | CGGN{18}CAG | 28 | 10 | 1.14 |
| 377 (SEQ ID NO:726) | AGCN{1}GCC | 57 | 28 | 1.13 |
| 378 (SEQ ID NO:727) | CGCN{18}GGC | 23 | 7 | 1.13 |
| 379 (SEQ ID NO:728) | CCCN{5}AGG | 64 | 33 | 1.11 |
| 380 (SEQ ID NO:729) | AACN{0}GCG | 9 | 1 | 1.11 |
| 381 (SEQ ID NO:730) | CCCN{10}CCA | 88 | 50 | 1.09 |
| 382 (SEQ ID NO:731) | CGCN{13}GAG | 20 | 6 | 1.09 |
| 383 (SEQ ID NO:732) | CGCN{7}GCC | 25 | 8 | 1.08 |
| 384 (SEQ ID NO:733) | CCCN{9}CCG | 28 | 10 | 1.07 |
| 385 (SEQ ID NO:734) | CGCN{16}CCC | 24 | 8 | 1.05 |
| 386 (SEQ ID NO:735) | GAAN{13}CGC | 18 | 5 | 1.05 |
| 387 (SEQ ID NO:736) | GGCN{3}CCC | 49 | 23 | 1.03 |
| 388 (SEQ ID NO:737) | TCCN{11}CCA | 87 | 50 | 1.03 |
| 389 (SEQ ID NO:738) | CACN{0}CCC | 70 | 38 | 1.02 |
| 390 (SEQ ID NO:739) | CGCN{16}CCG | 15 | 3 | 1.02 |
| 391 (SEQ ID NO:740) | CGGN{15}AGC | 21 | 6 | 1.02 |
| 392 (SEQ ID NO:741) | CCCN{12}GCG | 21 | 6 | 1.02 |
| 393 (SEQ ID NO:742) | CCCN{9}GAG | 59 | 30 | 1.01 |
| 394 (SEQ ID NO:743) | CCGN{20}TCC | 24 | 8 | 1.01 |
| 395 (SEQ ID NO:744) | CGCN{0}CGC | 17 | 4 | 1.01 |
| 396 (SEQ ID NO:745) | ATGN{7}CGG | 20 | 6 | 1 |
| 397 (SEQ ID NO:746) | GGGN{20}GCA | 59 | 30 | 1 |
| 398 (SEQ ID NO:747) | CGGN{4}GGC | 26 | 9 | 0.99 |
| 399 (SEQ ID NO:748) | CGGN{16}AGC | 22 | 7 | 0.99 |
| 400 (SEQ ID NO:749) | CGGN{5}GGC | 25 | 8 | 0.99 |
| 401 (SEQ ID NO:750) | GCGN{0}GGA | 25 | 8 | 0.98 |
| 402 (SEQ ID NO:751) | GGCN{20}CAC | 52 | 25 | 0.98 |
| 403 (SEQ ID NO:752) | CCCN{9}CCC | 97 | 58 | 0.97 |

TABLE 10-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk.

| Number | Dyad sequence | Observed occurrences | Expected occurrences | Significance coefficient |
|---|---|---|---|---|
| 404 (SEQ ID NO:753) | ACCN{17}GGC | 44 | 20 | 0.97 |
| 405 (SEQ ID NO:754) | CCCN{6}CGA | 18 | 5 | 0.96 |
| 406 (SEQ ID NO:755) | AAGN{10}CGG | 26 | 9 | 0.96 |
| 407 (SEQ ID NO:756) | CGCN{17}CAC | 21 | 6 | 0.95 |
| 408 (SEQ ID NO:757) | CCCN{16}CGG | 25 | 8 | 0.94 |
| 409 (SEQ ID NO:758) | GACN{18}GGC | 39 | 17 | 0.94 |
| 410 (SEQ ID NO:759) | GGGN{15}GAC | 47 | 22 | 0.92 |
| 411 (SEQ ID NO:760) | GCCN{4}TCC | 66 | 35 | 0.92 |
| 412 (SEQ ID NO:761) | GGCN{15}CCC | 56 | 28 | 0.92 |
| 413 (SEQ ID NO:762) | CAGN{12}CGC | 24 | 8 | 0.92 |
| 414 (SEQ ID NO:763) | CCAN{3}GCG | 22 | 7 | 0.91 |
| 415 (SEQ ID NO:764) | CCGN{16}GAG | 22 | 7 | 0.9 |
| 416 (SEQ ID NO:765) | AGCN{2}CGC | 24 | 8 | 0.89 |
| 417 (SEQ ID NO:766) | GAGN{4}CCC | 54 | 27 | 0.89 |
| 418 (SEQ ID NO:767) | AGGN{3}CGC | 23 | 7 | 0.88 |
| 419 (SEQ ID NO:768) | CACN{13}AGG* | 67 | 36 | 0.88 |
| 420 (SEQ ID NO:769) | CCCN{4}CAG | 88 | 51 | 0.88 |
| 421 (SEQ ID NO:770) | CCCN{2}GAA | 63 | 33 | 0.87 |
| 422 (SEQ ID NO:771) | CGCN{19}GAG | 21 | 6 | 0.87 |
| 423 (SEQ ID NO:772) | ACGN{18}GGG | 21 | 6 | 0.87 |
| 424 (SEQ ID NO:773) | CCCN{4}GGC | 62 | 32 | 0.87 |
| 425 (SEQ ID NO:774) | CGGN{9}GAG | 28 | 10 | 0.86 |
| 426 (SEQ ID NO:775) | CCCN{3}GGG | 66 | 26 | 0.86 |
| 427 (SEQ ID NO:776) | GAGN{4}GGC | 66 | 35 | 0.85 |
| 428 (SEQ ID NO:777) | CGCN{5}GAG | 18 | 5 | 0.84 |
| 429 (SEQ ID NO:778) | CCGN{20}AGG | 24 | 8 | 0.84 |
| 430 (SEQ ID NO:779) | CCCN{15}CCC | 88 | 51 | 0.83 |
| 431 (SEQ ID NO:780) | AGGN{17}CCG | 25 | 8 | 0.82 |
| 432 (SEQ ID NO:781) | AGGN{6}GGG | 89 | 52 | 0.82 |
| 433 (SEQ ID NO:782) | GGCN{20}CCC | 57 | 29 | 0.82 |
| 434 (SEQ ID NO:783) | GCAN{17}CGC | 19 | 5 | 0.82 |
| 435 (SEQ ID NO:784) | CGAN{11}ACG | 9 | 1 | 0.81 |
| 436 (SEQ ID NO:785) | CGCN{2}GGA | 19 | 5 | 0.81 |
| 437 (SEQ ID NO:786) | CTGN{5}CCC | 79 | 45 | 0.8 |
| 438 (SEQ ID NO:787) | TCCN{20}CCA | 77 | 43 | 0.8 |
| 439 (SEQ ID NO:788) | CCAN{2}GGG | 59 | 30 | 0.8 |
| 440 (SEQ ID NO:789) | CCGN{15}GCG | 14 | 3 | 0.8 |
| 441 (SEQ ID NO:790) | CCAN{5}GGG | 69 | 38 | 0.79 |
| 442 (SEQ ID NO:791) | CGGN{1}TGC | 24 | 8 | 0.79 |
| 443 (SEQ ID NO:792) | CCCN{14}GCG | 21 | 6 | 0.79 |
| 444 (SEQ ID NO:793) | CAGN{0}CCG | 27 | 10 | 0.79 |
| 445 (SEQ ID NO:794) | GCCN{9}TCC | 60 | 31 | 0.78 |
| 446 (SEQ ID NO:795) | AGGN{20}CGC | 22 | 7 | 0.78 |
| 447 (SEQ ID NO:796) | CCCN{6}GAC | 42 | 19 | 0.77 |
| 448 (SEQ ID NO:797) | CGGN{11}CCA | 23 | 7 | 0.76 |
| 449 (SEQ ID NO:798) | GGGN{14}CAC | 57 | 29 | 0.75 |

TABLE 10-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk.

| Number | Dyad sequence | Observed occurrences | Expected occurrences | Significance coefficient |
|---|---|---|---|---|
| 450 | GCAN{15}CGC (SEQ ID NO:799) | 19 | 5 | 0.74 |
| 451 | CGCN{2}ACA (SEQ ID NO:800) | 20 | 6 | 0.74 |
| 452 | ACCN{9}CCC (SEQ ID NO:801) | 57 | 29 | 0.73 |
| 453 | GCGN{9}CGC (SEQ ID NO:802) | 20 | 3 | 0.73 |
| 454 | CAGN{15}GCG (SEQ ID NO:803) | 23 | 7 | 0.73 |
| 455 | CCCN{18}GTC (SEQ ID NO:804) | 45 | 21 | 0.72 |
| 456 | GCGN{3}CCC (SEQ ID NO:805) | 24 | 8 | 0.72 |
| 457 | CGGN{11}GCC (SEQ ID NO:806) | 23 | 8 | 0.72 |
| 458 | CCCN{1}CGG (SEQ ID NO:807) | 24 | 8 | 0.71 |
| 459 | GCCN{4}CCA (SEQ ID NO:808) | 70 | 38 | 0.71 |
| 460 | CCCN{4}CCG (SEQ ID NO:809) | 30 | 12 | 0.7 |
| 461 | CGTN{2}GCA (SEQ ID NO:810) | 21 | 6 | 0.7 |
| 462 | AGCN{7}TCG (SEQ ID NO:811) | 18 | 5 | 0.69 |
| 463 | CCGN{15}GAA (SEQ ID NO:812) | 20 | 6 | 0.69 |
| 464 | ACCN{5}CCC (SEQ ID NO:813) | 62 | 33 | 0.69 |
| 465 | CGCN{14}GAG (SEQ ID NO:814) | 19 | 5 | 0.68 |
| 466 | CCCN{7}CGC (SEQ ID NO:815) | 30 | 12 | 0.68 |
| 467 | GAGN{12}CGC (SEQ ID NO:816) | 21 | 6 | 0.68 |
| 468 | GGCN{17}CCC (SEQ ID NO:817) | 58 | 30 | 0.67 |
| 469 | ACGN{11}CTC (SEQ ID NO:818) | 21 | 7 | 0.65 |
| 470 | ACAN{9}CGG (SEQ ID NO:819) | 24 | 8 | 0.65 |
| 471 | CTGN{7}CCC (SEQ ID NO:820) | 82 | 47 | 0.65 |
| 472 | CCCN{2}GCC (SEQ ID NO:821) | 72 | 40 | 0.65 |
| 473 | CGGN{2}GCA (SEQ ID NO:822) | 24 | 8 | 0.64 |
| 474 | CCCN{0}TGC (SEQ ID NO:823) | 83 | 48 | 0.64 |
| 475 | CGCN{7}ACC (SEQ ID NO:824) | 18 | 5 | 0.63 |
| 476 | GCAN{2}GCC (SEQ ID NO:825) | 54 | 27 | 0.63 |
| 477 | GCGN{8}CCA (SEQ ID NO:826) | 20 | 6 | 0.63 |
| 478 | AGCN{0}CGC (SEQ ID NO:827) | 22 | 7 | 0.63 |
| 479 | GCGN{2}GCA (SEQ ID NO:828) | 18 | 5 | 0.63 |
| 480 | CCGN{2}GTC (SEQ ID NO:829) | 18 | 5 | 0.62 |
| 481 | CCGN{3}ACA (SEQ ID NO:830) | 21 | 7 | 0.62 |
| 482 | ACGN{13}TGG (SEQ ID NO:831) | 21 | 7 | 0.62 |
| 483 | CCAN{8}CGC (SEQ ID NO:832) | 23 | 8 | 0.62 |
| 484 | CCGN{9}GGC (SEQ ID NO:833) | 23 | 8 | 0.61 |
| 485 | CCAN{5}CCG (SEQ ID NO:834) | 25 | 9 | 0.61 |
| 486 | AGGN{3}GGG (SEQ ID NO:835) | 97 | 59 | 0.61 |
| 487 | CAGN{2}GGC (SEQ ID NO:836) | 78 | 45 | 0.61 |
| 488 | CCCN{8}CAG (SEQ ID NO:837) | 81 | 47 | 0.61 |
| 489 | AGCN{5}CAG (SEQ ID NO:838) | 80 | 46 | 0.6 |
| 490 | CGGN{16}GCC (SEQ ID NO:839) | 22 | 7 | 0.6 |
| 491 | GCGN{15}CCC (SEQ ID NO:840) | 23 | 8 | 0.6 |
| 492 | CCCN{11}GCC (SEQ ID NO:841) | 59 | 31 | 0.59 |
| 493 | CGAN{2}ACG (SEQ ID NO:842 | 9 | 1 | 0.59 |
| 494 | CGGN{4}GCC (SEQ ID NO:843) | 22 | 7 | 0.59 |
| 495 | CACN{6}CGC (SEQ ID NO:844) | 19 | 6 | 0.59 |

TABLE 10-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk.

| Number | Dyad sequence | Observed occurrences | Expected occurrences | Significance coefficient |
|---|---|---|---|---|
| 496 (SEQ ID NO:845) | CGGN{5}ACG | 11 | 2 | 0.59 |
| 497 (SEQ ID NO:846) | CTGN{4}GCC* | 66 | 36 | 0.59 |
| 498 (SEQ ID NO:847) | GGGN{18}CGA | 18 | 5 | 0.59 |
| 499 (SEQ ID NO:848) | CCTN{8}CGC | 22 | 7 | 0.59 |
| 500 (SEQ ID NO:849) | GCCN{4}CCC | 67 | 37 | 0.58 |
| 501 (SEQ ID NO:850) | CGGN{10}GCC | 22 | 7 | 0.58 |
| 502 (SEQ ID NO:851) | GCCN{5}GGA | 54 | 27 | 0.57 |
| 503 (SEQ ID NO:852) | ACCN{7}GCG | 15 | 4 | 0.57 |
| 504 (SEQ ID NO:853) | CCCN{8}CGC | 24 | 8 | 0.57 |
| 505 (SEQ ID NO:854) | CAGN{5}CCC | 77 | 44 | 0.56 |
| 506 (SEQ ID NO:855) | CACN{14}GGA | 63 | 34 | 0.56 |
| 507 (SEQ ID NO:856) | CCCN{1}GCC | 94 | 57 | 0.55 |
| 508 (SEQ ID NO:857) | CCCN{5}AGC | 67 | 37 | 0.55 |
| 509 (SEQ ID NO:858) | GGCN{5}GGA | 59 | 31 | 0.55 |
| 510 (SEQ ID NO:859) | CGAN{17}GAG | 19 | 6 | 0.55 |
| 511 (SEQ ID NO:860) | CGCN{7}ACA | 18 | 5 | 0.54 |
| 512 (SEQ ID NO:861) | CCAN{13}CCC | 87 | 52 | 0.54 |
| 513 (SEQ ID NO:862) | CGGN{20}GGC | 24 | 8 | 0.54 |
| 514 (SEQ ID NO:863) | CCCN{17}GCC | 58 | 30 | 0.53 |
| 515 (SEQ ID NO:864) | CCTN{10}CCG | 30 | 12 | 0.53 |
| 516 (SEQ ID NO:865) | CCCN{8}CCG | 27 | 10 | 0.53 |
| 517 (SEQ ID NO:866) | CGCN{3}GAG | 18 | 5 | 0.52 |
| 518 (SEQ ID NO:867) | CGCN{7}AAG | 17 | 5 | 0.51 |
| 519 (SEQ ID NO:868) | CGGN{11}GGA | 23 | 8 | 0.51 |
| 520 (SEQ ID NO:869) | CCGN{15}CCG | 15 | 4 | 0.51 |
| 521 (SEQ ID NO:870) | CCCN{3}GCA | 57 | 30 | 0.51 |
| 522 (SEQ ID NO:871) | CGGN{2}CAG | 24 | 8 | 0.5 |
| 523 (SEQ ID NO:872) | AGGN{2}CCG | 24 | 8 | 0.5 |
| 524 (SEQ ID NO:873) | CCCN{4}CAC | 69 | 38 | 0.5 |
| 525 (SEQ ID NO:874) | GGAN{19}CCC | 56 | 29 | 0.49 |
| 526 (SEQ ID NO:875) | CCCN{8}CAC | 68 | 38 | 0.49 |
| 527 (SEQ ID NO:876) | ACCN{6}CCG | 18 | 5 | 0.49 |
| 528 (SEQ ID NO:877) | CCCN{6}GGC | 54 | 28 | 0.49 |
| 529 (SEQ ID NO:878) | CCCN{6}CCG | 29 | 11 | 0.48 |
| 530 (SEQ ID NO:879) | CGCN{14}GCC | 26 | 9 | 0.47 |
| 531 (SEQ ID NO:880) | CCGN{5}TCC | 25 | 9 | 0.46 |
| 532 (SEQ ID NO:881) | GCCN{6}GCC | 55 | 28 | 0.46 |
| 533 (SEQ ID NO:882) | CGGN{7}GGA | 24 | 8 | 0.45 |
| 534 (SEQ ID NO:883) | GGGN{6}GGA | 87 | 52 | 0.44 |
| 535 (SEQ ID NO:884) | GCCN{12}TCC | 60 | 32 | 0.44 |
| 536 (SEQ ID NO:885) | AGTN{16}CCG | 17 | 5 | 0.44 |
| 537 (SEQ ID NO:886) | GGCN{19}GCC | 68 | 29 | 0.44 |
| 538 (SEQ ID NO:887) | CCGN{3}CCG | 22 | 7 | 0.44 |
| 539 (SEQ ID NO:888) | CCCN{8}ACC | 58 | 31 | 0.44 |
| 540 (SEQ ID NO:889) | CAGN{15}GCC | 77 | 44 | 0.44 |
| 541 (SEQ ID NO:890) | CCCN{17}CGG | 24 | 8 | 0.44 |

TABLE 10-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk.

| Number | Dyad sequence | Observed occurrences | Expected occurrences | Significance coefficient |
|---|---|---|---|---|
| 542 | GCGN{1}CCA (SEQ ID NO:891) | 22 | 7 | 0.44 |
| 543 | CCCN{14}CAG (SEQ ID NO:892) | 79 | 46 | 0.44 |
| 544 | CCCN{8}CCC (SEQ ID NO:893) | 89 | 53 | 0.44 |
| 545 | ACAN{12}GCG (SEQ ID NO:894) | 23 | 8 | 0.43 |
| 546 | AGGN{4}CCG (SEQ ID NO:895) | 23 | 8 | 0.43 |
| 547 | CGCN{13}GCC (SEQ ID NO:896) | 23 | 8 | 0.43 |
| 548 | GAGN{2}CGC (SEQ ID NO:897) | 23 | 8 | 0.42 |
| 549 | CCCN{9}GCG (SEQ ID NO:898) | 21 | 7 | 0.42 |
| 550 | CGCN{17}ACA (SEQ ID NO:899) | 17 | 5 | 0.42 |
| 551 | GCGN{17}CCA (SEQ ID NO:900) | 23 | 8 | 0.42 |
| 552 | AAGN{18}CCG (SEQ ID NO:901) | 20 | 6 | 0.42 |
| 553 | CGCN{1}GGA (SEQ ID NO:902) | 18 | 5 | 0.41 |
| 554 | CCAN{1}CCC (SEQ ID NO:903) | 90 | 54 | 0.41 |
| 555 | CGTN{18}TGC (SEQ ID NO:904) | 20 | 6 | 0.41 |
| 556 | TCCN{14}CGA (SEQ ID NO:905) | 17 | 5 | 0.41 |
| 557 | CACN{5}GGG (SEQ ID NO:906) | 56 | 29 | 0.4 |
| 558 | CCGN{12}GCA (SEQ ID NO:907) | 21 | 7 | 0.4 |
| 559 | CTGN{6}CCC (SEQ ID NO:908) | 77 | 44 | 0.4 |
| 560 | CGGN{8}GGC (SEQ ID NO:909) | 32 | 13 | 0.4 |
| 561 | CCAN{11}GGG (SEQ ID NO:910) | 68 | 38 | 0.4 |
| 562 | ACGN{19}CAA (SEQ ID NO:911) | 21 | 7 | 0.39 |
| 563 | GGGN{20}CCC (SEQ ID NO:912) | 72 | 31 | 0.39 |
| 564 | CGCN{3}CAG (SEQ ID NO:913) | 23 | 8 | 0.39 |
| 565 | AGCN{17}GGG (SEQ ID NO:914) | 58 | 31 | 0.37 |
| 566 | CACN{20}CCG (SEQ ID NO:915) | 21 | 7 | 0.37 |
| 567 | ACGN{17}CAG (SEQ ID NO:916) | 24 | 8 | 0.37 |
| 568 | AGGN{1}CCC (SEQ ID NO:917) | 60 | 32 | 0.37 |
| 569 | CGTN{12}CAC (SEQ ID NO:918) | 20 | 6 | 0.37 |
| 570 | CGGN{9}GGC (SEQ ID NO:919) | 23 | 8 | 0.37 |
| 571 | CGCN{10}GCG (SEQ ID NO:920) | 18 | 3 | 0.37 |
| 572 | CCCN{6}CTC (SEQ ID NO:921) | 80 | 47 | 0.36 |
| 573 | CCGN{10}AGG (SEQ ID NO:922) | 23 | 8 | 0.36 |
| 574 | CCCN{18}CAG (SEQ ID NO:923) | 79 | 46 | 0.36 |
| 575 | AGCN{17}CCG (SEQ ID NO:924) | 21 | 7 | 0.36 |
| 576 | AGCN{9}GCG (SEQ ID NO:925) | 18 | 5 | 0.36 |
| 577 | CCAN{3}GGC (SEQ ID NO:926) | 62 | 34 | 0.36 |
| 578 | CCCN{11}GGC (SEQ ID NO:927) | 57 | 30 | 0.35 |
| 579 | ACGN{5}GCA (SEQ ID NO:928) | 23 | 8 | 0.35 |
| 580 | CCCN{14}CGG (SEQ ID NO:929) | 23 | 8 | 0.35 |
| 581 | CCCN{5}CCA (SEQ ID NO:930) | 91 | 55 | 0.35 |
| 582 | CCGN{1}AGG (SEQ ID NO:931) | 22 | 7 | 0.34 |
| 583 | GGGN{10}GAC (SEQ ID NO:932) | 45 | 22 | 0.34 |
| 584 | CGCN{15}CCA (SEQ ID NO:933) | 20 | 6 | 0.34 |
| 585 | CCTN{19}CGC (SEQ ID NO:934) | 22 | 7 | 0.34 |
| 586 | CGTN{3}CGC (SEQ ID NO:935) | 10 | 2 | 0.33 |
| 587 | AGCN{14}CCG (SEQ ID NO:936) | 21 | 7 | 0.33 |

TABLE 10-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk.

| Number | Dyad sequence | Observed occurrences | Expected occurrences | Significance coefficient |
|---|---|---|---|---|
| 588 | GGCN{2}CGA (SEQ ID NO:937) | 17 | 5 | 0.33 |
| 589 | CAGN{8}CCC (SEQ ID NO:938) | 79 | 46 | 0.33 |
| 590 | CCGN{2}GAC (SEQ ID NO:939) | 16 | 4 | 0.33 |
| 591 | AGCN{19}AGG (SEQ ID NO:940) | 70 | 40 | 0.32 |
| 592 | CCTN{4}GGC (SEQ ID NO:941) | 64 | 35 | 0.32 |
| 593 | CCGN{11}AGC (SEQ ID NO:942) | 22 | 7 | 0.32 |
| 594 | CACN{4}CGC (SEQ ID NO:943) | 18 | 5 | 0.32 |
| 595 | CCGN{1}CCC (SEQ ID NO:944) | 30 | 12 | 0.31 |
| 596 | CTGN{13}GGC (SEQ ID NO:945) | 73 | 42 | 0.31 |
| 597 | CGCN{16}ACC (SEQ ID NO:946) | 15 | 4 | 0.31 |
| 598 | CACN{18}CAG (SEQ ID NO:947) | 79 | 46 | 0.31 |
| 599 | GGCN{8}GCC (SEQ ID NO:948) | 68 | 29 | 0.29 |
| 600 | GGGN{15}GGA (SEQ ID NO:949) | 78 | 46 | 0.29 |
| 601 | CCGN{16}GCC (SEQ ID NO:950) | 22 | 7 | 0.29 |
| 602 | CCGN{20}ACC (SEQ ID NO:951) | 18 | 5 | 0.29 |
| 603 | CGAN{7}CCC (SEQ ID NO:952) | 17 | 5 | 0.28 |
| 604 | CCGN{6}CTC (SEQ ID NO:953) | 23 | 8 | 0.28 |
| 605 | CGGN{10}CTC (SEQ ID NO:954) | 22 | 7 | 0.28 |
| 606 | CAGN{16}CGC (SEQ ID NO:955) | 23 | 8 | 0.28 |
| 607 | CCAN{3}AGG (SEQ ID NO:956) | 77 | 45 | 0.27 |
| 608 | GCCN{18}GCC (SEQ ID NO:957) | 52 | 27 | 0.27 |
| 609 | CGCN{18}GGA (SEQ ID NO:958) | 19 | 6 | 0.26 |
| 610 | CCGN{20}GGC (SEQ ID NO:959) | 22 | 7 | 0.26 |
| 611 | ACAN{10}GCG (SEQ ID NO:960) | 17 | 5 | 0.26 |
| 612 | CGGN{5}CCC (SEQ ID NO:961) | 25 | 9 | 0.25 |
| 613 | CCCN{7}TCC (SEQ ID NO:962) | 75 | 43 | 0.25 |
| 614 | ACGN{10}CGC (SEQ ID NO:963) | 10 | 2 | 0.25 |
| 615 | CCCN{3}TCC (SEQ ID NO:964) | 81 | 48 | 0.25 |
| 616 | CCGN{8}CGG (SEQ ID NO:965) | 20 | 3 | 0.24 |
| 617 | CCAN{15}CGG (SEQ ID NO:966) | 22 | 7 | 0.24 |
| 618 | CCGN{6}CCG (SEQ ID NO:967) | 17 | 5 | 0.24 |
| 619 | CAGN{3}GCG (SEQ ID NO:968) | 25 | 9 | 0.24 |
| 620 | GAGN{1}CCC (SEQ ID NO:969) | 62 | 34 | 0.24 |
| 621 | CCGN{18}TGC (SEQ ID NO:970) | 22 | 7 | 0.23 |
| 622 | CCCN{7}CCA (SEQ ID NO:971) | 85 | 51 | 0.23 |
| 623 | CGGN{3}CCA (SEQ ID NO:972) | 24 | 9 | 0.23 |
| 624 | ACGN{1}CCC (SEQ ID NO:973) | 18 | 5 | 0.23 |
| 625 | CGGN{13}TGA (SEQ ID NO:974) | 21 | 7 | 0.22 |
| 626 | CTCN{6}GGC (SEQ ID NO:975) | 53 | 28 | 0.22 |
| 627 | GCGN{2}GAC (SEQ ID NO:976) | 15 | 4 | 0.22 |
| 628 | GGGN{11}ACC (SEQ ID NO:977) | 49 | 25 | 0.22 |
| 629 | CGCN{4}GGA (SEQ ID NO:978) | 17 | 5 | 0.22 |
| 630 | CCCN{11}CCG (SEQ ID NO:979) | 27 | 10 | 0.22 |
| 631 | CCGN{19}GCA (SEQ ID NO:980) | 20 | 6 | 0.22 |

TABLE 10-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk.

| Number | Dyad sequence | Observed occurrences | Expected occurrences | Significance coefficient |
|---|---|---|---|---|
| 632 | GCGN{0}GCA (SEQ ID NO:981) | 20 | 6 | 0.21 |
| 633 | AGAN{7}CCC (SEQ ID NO:982) | 61 | 33 | 0.21 |
| 634 | CGGN{2}CCA (SEQ ID NO:983) | 21 | 7 | 0.21 |
| 635 | CCCN{7}CCC (SEQ ID NO:984) | 89 | 54 | 0.21 |
| 636 | ACCN{4}GCG (SEQ ID NO:985) | 15 | 4 | 0.2 |
| 637 | CCTN{15}CGC (SEQ ID NO:986) | 20 | 6 | 0.2 |
| 638 | AGCN{9}GTC (SEQ ID NO:987) | 44 | 21 | 0.2 |
| 639 | CCCN{18}CTC (SEQ ID NO:988) | 74 | 43 | 0.2 |
| 640 | CGCN{18}CGA (SEQ ID NO:989) | 9 | 1 | 0.19 |
| 641 | CCCN{15}GCC (SEQ ID NO:990) | 62 | 34 | 0.18 |
| 642 | ACCN{11}GGC (SEQ ID NO:991) | 45 | 22 | 0.18 |
| 643 | AGGN{15}CGC (SEQ ID NO:992) | 29 | 12 | 0.18 |
| 644 | GCGN{0}CCA (SEQ ID NO:993) | 27 | 10 | 0.18 |
| 645 | GCGN{9}AGC (SEQ ID NO:994) | 18 | 5 | 0.17 |
| 646 | GGGN{18}GCA (SEQ ID NO:995) | 59 | 32 | 0.17 |
| 647 | CCCN{17}CAG (SEQ ID NO:996) | 77 | 45 | 0.17 |
| 648 | CCAN{8}CGG (SEQ ID NO:997) | 22 | 8 | 0.16 |
| 649 | CCGN{10}GGC (SEQ ID NO:998) | 21 | 7 | 0.16 |
| 650 | GCAN{0}GCC (SEQ ID NO:999) | 76 | 44 | 0.16 |
| 651 | CAGN{2}CGC (SEQ ID NO:1000) | 20 | 6 | 0.16 |
| 652 | CGCN{8}GGC (SEQ ID NO:1001) | 19 | 6 | 0.16 |
| 653 | CTGN{17}GGC (SEQ ID NO:1002) | 65 | 36 | 0.16 |
| 654 | GGGN{14}ACC (SEQ ID NO:1003) | 46 | 23 | 0.16 |
| 655 | CCGN{1}TGC (SEQ ID NO:1004) | 20 | 6 | 0.16 |
| 656 | CAGN{8}CGC (SEQ ID NO:1005) | 22 | 8 | 0.15 |
| 657 | AAGN{11}CGC (SEQ ID NO:1006) | 17 | 5 | 0.15 |
| 658 | CCGN{6}TCC (SEQ ID NO:1007) | 22 | 8 | 0.14 |
| 659 | CCAN{18}CCC (SEQ ID NO:1008) | 72 | 42 | 0.14 |
| 660 | CCAN{0}CCC (SEQ ID NO:1009) | 84 | 51 | 0.14 |
| 661 | GAGN{6}CCC (SEQ ID NO:1010) | 53 | 28 | 0.14 |
| 662 | AGCN{20}GGC (SEQ ID NO:1011) | 52 | 27 | 0.14 |
| 663 | CAGN{0}CGC (SEQ ID NO:1012) | 21 | 7 | 0.14 |
| 664 | CCGN{12}CTC (SEQ ID NO:1013) | 22 | 8 | 0.14 |
| 665 | CGCN{15}ACG (SEQ ID NO:1014) | 9 | 1 | 0.13 |
| 666 | GGCN{17}CGA (SEQ ID NO:1015) | 15 | 4 | 0.13 |
| 667 | CCGN{16}AAG (SEQ ID NO:1016) | 19 | 6 | 0.13 |
| 668 | CGCN{14}TCC (SEQ ID NO:1017) | 19 | 6 | 0.12 |
| 669 | AGGN{7}CGC (SEQ ID NO:1018) | 20 | 7 | 0.12 |
| 670 | CGGN{7}CCC (SEQ ID NO:1019) | 22 | 8 | 0.12 |
| 671 | CGCN{4}GCC (SEQ ID NO:1020) | 34 | 15 | 0.12 |
| 672 | CGAN{6}CCC (SEQ ID NO:1021) | 17 | 5 | 0.12 |
| 673 | CCCN{19}GGA (SEQ ID NO:1022) | 60 | 33 | 0.11 |
| 674 | CCCN{16}GCG (SEQ ID NO:1023) | 28 | 11 | 0.11 |
| 675 | CCAN{7}CGC (SEQ ID NO:1024) | 20 | 7 | 0.11 |
| 676 | CCCN{6}GCC (SEQ ID NO:1025) | 80 | 48 | 0.11 |
| 677 | GCCN{14}TCC (SEQ ID NO:1026) | 55 | 29 | 0.11 |

TABLE 10-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk.

| Number | Dyad sequence | Observed occurrences | Expected occurrences | Significance coefficient |
|---|---|---|---|---|
| 678 (SEQ ID NO:1027) | AGGN{14}GCC | 64 | 36 | 0.1 |
| 679 (SEQ ID NO:1028) | CGCN{11}GCC | 20 | 7 | 0.1 |
| 680 (SEQ ID NO:1029) | TCCN{0}GCA | 17 | 5 | 0.09 |
| 681 (SEQ ID NO:1030) | GCGN{8}CCC | 27 | 11 | 0.09 |
| 682 (SEQ ID NO:1031) | CCAN{11}GCG | 19 | 6 | 0.09 |
| 683 (SEQ ID NO:1032) | CACN{4}GGG | 51 | 26 | 0.09 |
| 684 (SEQ ID NO:1033) | CGGN{7}TCC | 20 | 7 | 0.09 |
| 685 (SEQ ID NO:1034) | GCGN{5}GCC | 20 | 7 | 0.09 |
| 686 (SEQ ID NO:1035) | ACGN{12}CAG | 26 | 10 | 0.09 |
| 687 (SEQ ID NO:1036) | CCGN{19}CGC | 14 | 4 | 0.08 |
| 688 (SEQ ID NO:1037) | CGGN{8}TGC | 18 | 5 | 0.08 |
| 689 (SEQ ID NO:1038) | CCCN{1}GAG | 65 | 37 | 0.07 |
| 690 (SEQ ID NO:1039) | GCGN{19}TGA | 18 | 6 | 0.07 |
| 691 (SEQ ID NO:1040) | GGCN{15}GCC | 70 | 31 | 0.07 |
| 692 (SEQ ID NO:1041) | CCGN{7}CCC | 27 | 11 | 0.07 |
| 693 (SEQ ID NO:1042) | ACAN{19}CCC | 63 | 35 | 0.07 |
| 694 (SEQ ID NO:1043) | ACCN{16}GGG | 47 | 24 | 0.07 |
| 695 (SEQ ID NO:1044) | AGAN{1}GGC | 64 | 36 | 0.07 |
| 696 (SEQ ID NO:1045) | GGGN{17}TGA | 64 | 36 | 0.06 |
| 697 (SEQ ID NO:1046) | CAGN{5}GGG | 83 | 50 | 0.06 |
| 698 (SEQ ID NO:1047) | GCCN{13}CGC | 22 | 8 | 0.06 |
| 699 (SEQ ID NO:1048) | GCGN{7}GGA | 19 | 6 | 0.06 |
| 700 (SEQ ID NO:1049) | CAGN{14}CCA | 94 | 58 | 0.06 |
| 701 (SEQ ID NO:1050) | CCGN{4}GTC | 16 | 4 | 0.06 |
| 702 (SEQ ID NO:1051) | CCCN{13}CGC | 22 | 8 | 0.06 |
| 703 (SEQ ID NO:1052) | GCGN{14}ACC | 15 | 4 | 0.05 |
| 704 (SEQ ID NO:1053) | CAGN{20}GGG | 81 | 49 | 0.05 |
| 705 (SEQ ID NO:1054) | CCGN{4}CCC | 27 | 11 | 0.05 |
| 706 (SEQ ID NO:1055) | CGCN{5}GGC | 18 | 6 | 0.05 |
| 707 (SEQ ID NO:1056) | CCTN{6}GGC | 57 | 31 | 0.05 |
| 708 (SEQ ID NO:1057) | AGGN{3}GGC | 67 | 38 | 0.05 |
| 709 (SEQ ID NO:1058) | CGGN{11}CGC | 14 | 4 | 0.05 |
| 710 (SEQ ID NO:1059) | CTGN{18}GGA | 77 | 46 | 0.04 |
| 711 (SEQ ID NO:1060) | CACN{17}CCA | 74 | 43 | 0.04 |
| 712 (SEQ ID NO:1061) | CGGN{3}GAG | 22 | 8 | 0.04 |
| 713 (SEQ ID NO:1062) | CCCN{9}CCA | 82 | 49 | 0.03 |
| 714 (SEQ ID NO:1063) | CCCN{1}ACG | 18 | 6 | 0.03 |
| 715 (SEQ ID NO:1064) | CAGN{1}GCC | 72 | 42 | 0.03 |
| 716 (SEQ ID NO:1065) | AGGN{6}CCG | 23 | 8 | 0.03 |
| 717 (SEQ ID NO:1066) | AGCN{9}GGG | 57 | 31 | 0.03 |
| 718 (SEQ ID NO:1067) | CCCN{7}GGC | 54 | 29 | 0.02 |
| 719 (SEQ ID NO:1068) | CCTN{13}CCC | 88 | 54 | 0.02 |
| 720 (SEQ ID NO:1069) | CCGN{19}TTC | 20 | 7 | 0.02 |
| 721 (SEQ ID NO:1070) | CCCN{7}CCG | 27 | 11 | 0.02 |

TABLE 10-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk.

| Number | Dyad sequence | Observed occurrences | Expected occurrences | Significance coefficient |
|---|---|---|---|---|
| 722 | CGAN{6}GGC (SEQ ID NO:1071) | 17 | 5 | 0.01 |
| 723 | CGGN{4}CTC (SEQ ID NO:1072) | 21 | 7 | 0.01 |
| 724 | CGGN{0}CGC (SEQ ID NO:1073) | 13 | 3 | 0.01 |
| 725 | CCTN{13}ACG (SEQ ID NO:1074) | 19 | 6 | 0.01 |
| 726 | GGGN{6}CAC (SEQ ID NO:1075) | 53 | 28 | 0.01 |
| 727 | CCCN{16}CGC (SEQ ID NO:1076) | 21 | 7 | 0.01 |
| 728 | CCCN{10}CTC (SEQ ID NO:1077) | 76 | 45 | 0 |
| 729 | CCCN{0}CAG (SEQ ID NO:1078) | 92 | 57 | 0 |
| 730 | GCCN{5}CCC (SEQ ID NO:1071) | 65 | 37 | 0 |

TABLE 11

Candidate STAR elements tested by Linear Discriminant Analysis

| Candidate STAR | Location[1] | Length |
|---|---|---|
| T2 F | 20q13.33 | ~2800 |
| T2 R | 6q14.1 | ~2800 |
| T3 F | 15q12 | ~2900 |
| T3 R | 7q31.2 | ~2900 |
| T5 F | 9q34.13 | ND[2] |
| T5 R | 9q34.13 | ND |
| T7 | 22q12.3 | ~1200 |
| T9 F | 21q22.2 | ~1600 |
| T9 R | 22q11.22 | ~1600 |
| T10 F | 7q22.2 | ~1300 |
| T10 R | 6q14.1 | ~1300 |
| T11 F | 17q23.3 | ~2000 |
| T11 R | 16q23.1 | ~2000 |
| T12 | 4p15.1 | ~2100 |
| T13 F | 20p13 | ~1700 |
| T13 R | 1p13.3 | ~1700 |
| T14 R | 11q25 | ~1500 |
| T17 | 2q31.3 | ND |
| T18 | 2q31.1 | ND |

[1]Chromosomal location is determined by BLAT search of DNA sequence data from the STAR elements against the human genome database. The location is given according to standard nomenclature referring to the cytogenetic ideogram of each chromosome; e.g., 1p2.3 is the third cytogenetic sub-band of the second cytogenetic band of the short arm of chromosome 1 (http://www.ncbi.nlm.nih.gov/Class/MLACourse/Genetics/chrombanding-.html). F, forward sequencing reaction result; R, reverse sequencing reaction result. When the forward and reverse sequencing results mapped to different genomic locations, each sequence was extended to the full length of the original clone (as determined by restriction mapping) based on sequence information from the human genome database.
[2]ND: Not Determined.

TABLE 12

Arabidopsis STAR elements of the invention, including chromosome location and length

| STAR | Chromosome | Length, kb |
|---|---|---|
| A1 | I | 1.2 |
| A2 | I | 0.9 |
| A3 | I | 0.9 |
| A4 | I | 0.8 |
| A5 | I | 1.3 |
| A6 | I | 1.4 |
| A7 | II | 1.2 |
| A8 | II | 0.8 |
| A9 | II | 0.9 |
| A10 | II | 1.7 |
| A11 | II | 1.9 |
| A12 | II | 1.4 |
| A13 | II | 1.2 |
| A14 | II | 2.1 |
| A15 | II | 1.4 |
| A16 | II | 0.7 |
| A17 | II | 1.5 |
| A18 | III | 1.5 |
| A19 | III | 0.7 |
| A20 | III | 2.0 |
| A21 | IV | 1.8 |
| A22 | IV | 0.8 |
| A23 | IV | 0.6 |
| A24 | IV | 0.5 |
| A25 | V | 0.9 |
| A26 | V | 1.9 |
| A27 | V | 1.1 |
| A28 | V | 1.6 |
| A29 | V | 0.9 |
| A30 | V | 2.0 |
| A31 | V | 2.0 |
| A32 | V | 1.3 |
| A33 | V | 0.9 |
| A34 | I | 0.9 |
| A35 | II | 1.1 |

SEQUENCE LISTING (1079 sequences)

SEQ ID NO: 1 - DNA, 749 bp, Artificial Sequence
  sequence of STAR1
atgcggtgggggcgcgccagagactcgtgggatccttggcttggatgtttggatctttctgagttgcctgtgccgcgaaagacaggtacatttctgattaggcctgtgaagcctcctggaggaccatctcattaagacgatggtattggagggagagtcacagaaagaactgtggcccctccctcactgcaaaacggaagtgattttattttaatgggagttggaatatgtgagggctgcaggaaccagtctccctccttcttggttggaaaagctggggctggcctcagagacaggttttttggccccgctgggctgggcagtctagtcgaccctttgtagactgtgcacacccctagaagagcaactacccctatacaccaggctggctcaagtgaaaggggctctgggctccagtctggaaaatctggtgtcctggggacctctggtcttgcttctctcctcccctgcactggctctgggtgcttatctctgcagaagcttctcgctagcaaacccacattcagcgccctgtagctgaacacagcacaaaaagccctagagatcaaaagcattagtatgggcagttgagcgggaggtgaatatttaacgcttttgttcatcaataactcgttggctttgacctgtctgaacaagtcgagcaataaggtgaaatgcaggtcacagcgtctaacaaatatgaaaatgtgtatattcaccccggtctccagccggcgcgccaggctccc

SEQ ID NO: 2 - DNA, 883 bp, Artificial Sequence
  sequence of STAR2
gggtgcttcctgaattcttccctgagaaggatggtggccggtaaggtccgtgtaggtggggtgcggctccccaggccccggcccgtggtggtggccgctgcccagcggcccggcacccccatagtccatggcgcccgaggcagcgtgggggaggtgagttagaccaaagagggctggcccggagttgctcatgggctccacatagctgccccccacgaagacggggcttccctgtatgtgtggggtcccatagctgccgttgccctgcaggccatgagcgtgcgggtcatagtcgggggtgccccctgcgcccgcccctgccgccgtgtagcgcttctgtgggggtggcgggggtgcgcagctgggcagggacgcagggtaggaggcggggggcagcccgtaggtaccctgggggggcttggagaagggcgggggcgactggggctcatacgggacgctgttgaccagcgaatgcatagagttcagatagccaccggctccggggggcacggggctgcgacttggagactggccccccgatgacgttagcatgcccttgcccttctgatcctttttgtacttcatgcggcgattctggaaccagatcttgatctggcgctcagtgaggttcagcagattggccatctccacccggcgcggccggcacaggtagcggttgaagtggaactctttctccagctccaccagctgcgcgctcgtgtaggccgtgcgcgcgcgcttggacgaagcctgccccggcgggctcttgtcgccagcgcagctttcgcctgcgaggacagagagaggaagagcggcgtcaggggctgccgcggccccgcccagcccctgacccagcccggcccctccttccaccaggccccaa

SEQ ID NO: 3 - DNA, 2126 bp, Artificial Sequence
  sequence of STAR3
atctcgagtactgaaataggagtaaatctgaagagcaaataagatgagccagaaaaccatgaaaagaacagggactaccagttgattccacaaggacattcccaaggtgagaaggccatatacctccactacctgaaccaattctctgtatgcagatttagcaaggttataaggtagcaaaagattagacccaagaaaatagagaacttccaatccagtaaaaatcatagcaaatttattgatgataacaattgtctccaaaggaacaaggcagagtcgtgctagcagaggaagcacgtgagctgaaaacagccaaatctgctttgttttcatgacacaggagcataaagtacacaccaccaactgacctattaaggctgtggtaaaccgattcatagagagaggttctaaatacattggtccctcacaggcaaactgcagttcgctccgaacgtagtccctggaaatttgatgtccagtatagaaaagcagagcagtcaaaaaatatagataaagctgaaccagatgttgcctgggcaatgttagcagcaccacacttaagatataacctcaggctgtggactccctccctggggagcggtgctgccggcggcgggcgggctccgcaactccccggctctctcgcccgccctcccgttctcctcgggcggcggcgggggccgggactgcgccgctcacagcggcggctcttctgcgcccggcctcggaggcagtggcggtggcggccatggcctcctgcgttcgccgatgtcagcatttcgaactgagggtcatctccttgggactggttagacagtgggtgcagcccacggagggcgagttgaagcagggtggggtgtcacctcccccaggaagtccagtgggtcagggaactccctcccctagccaagggaggccgtgagggactgtgcccggtgagagactgtgccctgaggaaaggtgcactctggcccagatactacacttttcccacggtcttcaaaacccgcagaccaggagattccctcgggttcctacaccaccaggaccctgggtttcaaccacaaaaccgggccatttgggcagacacccagctagctgcaagagttgtttttttttttatactcctgtggcacctggaacgccagcgagagagcacctttcactcccctggaaagggggctgaaggcagggacctttagctgcgggctagggggtttggggttgagtgggggaggggagagggaaaaggcctcgtcattggcgtcgtctgcagccaataaggctacgctcctctgctgcgagtagacccaatcctttcctagaggtggagggggcgggtaggtggaagtagaggtggcgcggtatctaggagagagaaaaagggctggaccaataggtgcccggaagaggcggacccagcggtctgttgattggtattggcagtggaccctcccccggggtggtgccggagggggggatgatgggtcgaggggtgtgtttatgtggaagcgagatgaccggcaggaacctgccccaatgggctgcagagtggttagtgagtgggtgacagacagacccgtaggccaacgggtggccttaagtgtctttggtctcctccaatggagcagcggcggggcgggaccgcgactcgggtttaatgagactccattgggctgtaatcagtgtcatgtcggattcatgtcaacgacaacaacagggggacacaaaatggcggcggcttagtcctacccctggcggcggcggcagcggtggcggaggcgacggcactcctccaggcggcagccgcagtttctcaggcagcggcagcgcccccggcaggcgcggtggcggtggcgcgcagccaggtctgtcacccaccccgcgcgttcccagggggaggagactgggcgggaggggggaacagacggggggggattcaggggcttgcgacgcccctcccacaggcctctgcgcgagggtcaccgcggggccgctcggggtcaggctgcccctgagcgtgacggtagggggcgggggaaaggggaggagggacaggccccgcccctcggcagggcctctagggcaagggggcggggctcgaggagcggaggggggcggggcgg

SEQ ID NO: 4 - DNA, 1625 bp, Artificial Sequence
  sequence of STAR4
gatctgagtcatgttttaaggggaggattcttttggctgctgagttgagattaggttgagggtagtgaaggtaaaggcagtgagaccacgtaggggtcattgcagtaatccaggctggagatgatggtggttcagttggaatagcagtgcatgtgctgtaacaacctcagctgggaagcagtatatgtggcgttatgacctcagctggaacagcaatgcatgtggtggtgtaatgaccccagctgggtagggtgcatgtggtgtaacgacctcagctgggtagcagtgtgtgtgatgtaacaacctcagctgggtagcagtgtacttgataaaatgttggcatactctagatttgttatgagggtagtgccattaaatttctccacaaattggttgtcacgtatgagtgaaaagaggaagtgatggaagacttcagtgcttttggcctgaataaatagaagacgtcatttccagttaatggagacagggaagactaaaggtagggtgggattcagtagagcaggtgttcagttttgaatatgatgaactctgagagaggaaaaactttttctacctcttagtttttgtgactggacttaagaattaaagtgacataagacagagtaacaagacaaaaatatgcgaggttatttaatatttttacttgcagaggggaatcttcaaaagaaaaatgaagacccaaagaagccattagggtcaaaagctcatatgcctttttaagtagaaaatgataaattttaacaatgtgagaagacaaaggtgtttgagctgagggcaataaattgtgggacagtgattaagaaatatatgggggaaatgaaatgataagttattttagtagatttattcttcatatctattttggcttcaacttccagtctctagtgataagaatgttcttctcttcctggtacagagagagcacctttctcatgggaaattttatgaccttgctgtaagtagaaaggggaagatcgatctcctgtttcccagcatcaggatgcaaacatttccctccattccagttctcaaccccatggctgggcctcatggcattccagcatcgctatgagtgcacctttcctgcaggctgcctcgggtagctggtgcactgctaggtcagtctatgtgaccaggagctgggcctctgggcaatgccagttggcagcccccatccctccactgctgggggcctcctatccagaagggcttggtgtgcagaacgatggtgcaccatcatcattccccacttgccatctttcaggggacagccagctgctttgggcgcggcaaaaaacacccaactcactcctcttcaggggcctctggtctgatgccaccacaggacatccttgagtgctgggcagtctgaggacagggaaggagtgatgaccacaaaacaggaatggcagcagcagtgacaggaggaagtcaaaggcttgtgtgtcctggccctgctgagggctggcgagggccctgggatggcgctcagtgcctggtcggctgcaagaggccagccctctgcccatgaggggagctggcagtgaccaagctgcactgccctggtggtgcatttcctgccccactctttccttctaagatcc

SEQ ID NO: 5 - DNA, 1571 bp, Artificial Sequence
  sequence of STAR5
agcagagatcttatttcccgtattcccttgtggcacagcacctcccacgccaaagcaaaccaaagcaaaggagcccttgatgaggaggggccttcccccaacctggtctcccacaggtcctacatacgtacccaccccagacacacagagctgcttcctgctctcacaccagactgagctgtgcccagacatttcccctagcactaaccaactctttcaaaaatacatttttctctaaaaagaacaagtttaaacaaagttgactcattttaagaactgtttagaagataaccttgtgtttattaattatgtatttgcagaaattggaggcagaaggttaccaacattgcctggtgtccagccaggaggtagagcgtggtggcatccagaaccttcctccaactcctgcctggcgtggtttttattcatctttgtattcccaagaaacttctcagtgtctcaggagtgttaggcactcagtacgtgtttggtagttacatgaatgaatgcataatgactaagtgagttaatggatgaagctaattgtctctcccttttgcttttccagagctttccaaggtgaaagtgttggacactctttcttcatctcagatttaatcaactaagaatgctgcaaattgaacaccagtccacaaaactcaggaatacatgaaaagcattgtgccttatttttaactaactcaaattctatgtcagtctcccttttatgctggatgttggcgctaaatctcagtgggttcctcattctgccagacctgtgtccagtttgggggcttcacatagagccaccccatcacaggagagggaagggtcttgctcttggttgccatcactccaccctcttgtcttccgagctttgatgttcactttccttttcaccactcggaagcttcctgccatgatacattgagacctcaatgttaatgccaattggggtttggggttctcataaactcagaagtccaggaaaatcgcctgctgcctcccacaacactctgagggcattctggaatcctaccacttacctggagcctgctggcctcaactgttttgaagtctgtgtctgggccatgcaggtaaatgggaggatgttctgtggccataaaaatacccgaagtcccacctaaagttgatgcagggtcttctgcatttcattgcaaaattgttctatcatttctatagttttcagcctacagtcaggggccaggactttgcacccttggtaaacctcaatctcttctccttcctggcttctactcctttctccctcaatcccaaatcaaggcccttgattgtctggaggtaggaaagcctggttctggctcatgatatagtctacatcatagcctttgtcatctcatggattcactcaacaaccgtgtgtggatggggccacccaatatgtgccaggagttgaggacacgcagggttatgatgatgaaatagataaggggcccacactcacggaccctgcaggacagtggagctgtggacccagcatgcgagtaaagacccagtgagctcaccagacagatcatttaaatcaggtg

SEQ ID NO: 6 - DNA, 1173 bp, Artificial Sequence
  sequence of STAR6
tgacccaccacagacatcccctctggcctcctgagtggtttcttcagcacagcttccagagccaaattaaacgttcactctatgtctatagacaaaaagggttttgactaaactctgtgttttagagagggagttaaatgctgttaactttttaggggtgggcgagagggatgacaaataacaacttgtctgaatgttttacatttctccccactgcctcaagaaggttcacaacgaggtcatccatgataaggagtaagacctcccagccggactgtccctcggcccccagaggacactccacagagatatgctaactggacttggagactggctcacactccagagaaaagcatggagcacgagcgcacagagcagggccaaggtcccagggacagaatgtctaggagggagattggggtgagggtaatctgatgcaattactgtggcagctcaacattcaagggagggggaagaaagaaacagtccctgtcaagtaagttgtgcagcagagatggtaagctccaaaatttgaaactttggctgctggaaagttttagggggcagagataagaagacataagagactttgagggtttactacacactagacgctctatgcatttatttatttattatctcttatttattactttgtataactcttataataatcttatgaaaacggaaaccctcatatacccattttacagatgagaaaagtgacaattttgagagcatagctaagaatagctagtaagtaaaggagctgggacctaaaccaaaccctatctcaccagagtacacactctttttttttttccagtgtaattttttttaatttttattttactttaagttctgggatacatgtgcagaaggtatggtttgttacataggtatatgtgtgccatagtggattgctgcacctatcaacccgtcatctaggtttaagccccacatgcattagctatttgtcctgatgctctccctcccctccccacaccagacaggccttggtgtgtgatgttcccctccctgtgtccatgtgttctcactgttcagctcccacttatgagtgagaacgtgtggtatttggttttctgttcctgtgttagtttgctgaggatgatggcttccagcttcatccatgtccctgcaaaggacacgatc

SEQ ID NO: 7 - DNA, 2101 bp, Artificial Sequence
  sequence of STAR7
atcatgccagcttaggcgacagagtgagactggacataataacaataataataaaaataaataaataaaacaattatctgagaggaaaaatttgattcataataaagagaataaaggtttttggcgtgtttgttttgttttcacctaagaacagctgttcccctcattgggttagttttatttgcaagcagaaatcatctccgcatgatttccagggtgatggaaaactgaatatgaatccaccttctgccatctattcacttgtcacatttaataagacactcatgcctattttagcatgttttcttccctaccaaatgagttagtaacatcaagagattaaaataacacaaataagaacattgaaggtattcaaatgttacatacaaatattaaacacaatattattataattattcctggaaatgacattgcctctactctcaaggtaaaggtcatttttcttgatttaaacttttttctcaagtttgaaatctctaagtttcaacccgtaatctatttgcaagtttgtgcaaattttagggattgaatccatagtaattagtgatttattgtggtgtagggagacaagtcaaaagaatcaggactgctaggtagatgactaaggaaaggatggttcacgaggtgacataaagcactcagaagaaaaaggtcaggaaacggaggacagaaaaaaacctaagttctgctgggtgatgctgaatttgtcatcacaaaatctgcattgtggaagctttagctattgaggagattgctcaagtgtagaactgagaacaataggcagtgaacccgagagaacatcaagagactgagagaaaatgaaccagacttccaggtgctccatgttccaaccaacattttgtattgtcagaaggaattgagaggcaaaaggaaacccaataaaaaataaaacaggaaagggcatacatgattaccaccccttttctcaccagctgctcatggaccagctttctcctagtgctattttcttggtcactgcatcactctgctaacatagtttccccactagctctgaggctgtcccagaggggaagccagctgtcatctccttcttccacactctgttggaggaacctgtcattagcagctccctactaaacgcatttatgacaaacaggcaggagataattaactagaaagtgaacaaactcaaacttcagagcctctcatttgtatgaatgcccttgtaaggtcttgggcctattttaatatttataaatgtgttattttcttctaaagaaaaccaccaaattgtataagctacagaatctgcaaaactgaggtccatccatgcactcaggatacattcatagcatctctgagctggaaaatatcttaaaggtcatatatgtcctccaacactgcaagaatctctctggcagcattcttttaaaatcatcatctaaaagagggaaatccccagctgtgtttggattttgctctgtcacttgtccagtttccccatccataaaagggcaacaatatgaatttcctgataaggtagttgttaatataaatacaaagtgcgtagccacttccctaagaaaaatatggggtttctgcttcacagtctagggagaggaaaaaaaaggggggtcagaagtgattattattatcattctatattggaatgttttcagacataaaaagctcaccacgtcttaggccagacagatgcattatgaaagttaagctaagtcttcctcatcatgagctgcacctatatccccattacttcttctagaactgcataatttatttattctttcttcaaaagtttgagagagccattcttgtcctctaagatttttttttttttttttggagacagagtctccgtctgttgcccaggctggagtgcaatggcactatctcagctcactgcaacctctgcctcccagattcaagtgattctcctgcctcagcctcccgagtagctgggattacaagcacgcaccaccacaaccagctaatttttcgtattttttagtagagacgaggttttaccatgttggccaggctggtcttgaactcctgacctcgggtgatccacccacct

SEQ ID NO: 8 - DNA, 1821 bp, Artificial Sequence
  sequence of STAR8
gagatcacctcgaagagagtctaacgtccgtaggaacgctctcgggttcacaaggattgaccgaaccccaggatacgtcgctctccatctgaggcttgctccaaatggccctccactattccaggcacgtgggtgtctcccctaactctccctgctctcctgagcccatgctgcctatcacccatcggtgcaggtcctttctgaagagctcgggtggattctctccatcccacttcctttcccaagaaagaagccaccgttccaagacacccaatgggacattccccttccacctccttctccaaagttgcccaggtgttcatcacaggttagggagagaagcccccaggtttcagttacaaggcataggacgctggcatgaacacacacacacacacacacacacacacacacacacacacacgactcgaagaggtagccacaagggtcattaaacacttgacgactgttttccaaaaacgtggatgcagttcatccacgccaaagccaagggtgcaaagcaaacacggaatggtggagagattccagaggctcaccaaaccctctcaggaatattttcctgaccctgggggcagaggttggaaacattgaggacatttcttgggacacacggagaagctgaccgaccaggcattttcctttccactgcaaatgacctatggcgggggcatttcactttcccctgcaaatcacctatggcgaggtacctccccaagcccccacccccacttccgcgaatcggcatggctcggcctctatccgggtgtcactccaggtaggcttctcaacgctctcggctcaaagaaggacaatcacaggtccaagcccaaagcccacacctcttccttttgttatacccacagaagttagagaaaacgccacactttgagacaaattaagagtcctttatttaagccggcggccaaagagatggctaacgctcaaaattctctgggccccgaggaaggggcttgactaacttctataccttggtttaggaaggggaggggaactcaaatgcggtaattctacagaagtaaaaacatgcaggaatcaaaagaagcaaatggttatagagagataaacagttttaaaaggcaaatggttacaaaaggcaacggtaccaggtgcggggctctaaatccttcatgacacttagatataggtgctatgctggacacgaactcaaggctttatgttgttatctcttcgagaaaaatcctgggaacttcatgcactgtttgtgccagtatcttatcagttgattgggctcccttgaaatgctgagtatctgcttacacaggtcaactccttgcggaagggggttgggtaaggagcccttcgtgtctcgtaaattaaggggtcgattggagtttgtccagcattcccagctacagagagccttatttacatgagaagcaaggctaggtgattaaagagaccaacagggaagattcaaagtagcgacttagagtaaaaacaaggttaggcatttcactttcccagagaacgcgcaaacattcaatgggagagaggtcccgagtcgtcaaagtcccagatgtggcgagcccccgggaggaaaaaccgtgtcttccttaggatgcccggaacaagagctaggcttccggagctaggcagccatctatgtccgtgagccggcgggagggagaccgccgggaggcgaagtggggcggggccatccttctttctgctctgctgctgccggggagctcctggctggcgtccaagcggcaggaggccgccgtcctgcagggcgccgtagagtttgcggtgcagagt

SEQ ID NO: 9 - DNA, 1929 bp, Artificial Sequence
  sequence of STAR9
atgagcccccaaaaatgatcctctggcttatgacaacctgatgcagcccaggaaatgcctgcaacatgcccactagcagctgggaacccctctgtgaggaagagaacgttttacattaagaaaccctttgttttgcagcagagactattcaggtcacacatgtgtggcctctcagttctttgagccatttgaagttctctatccttgctgggaggctgagctctccatggaaacctggtccgatagtgagaggagcagaccctctggaaacacctttttacacctgaccaaagcagccagtcatgggccagtgatgcaacaaggtcaaccggtgcattctggcccctcagaaaagcagcccccgggaaggtcaggaggaggctgctgactccctcttcccctgcagccgccccaagcacacccaggagccctgcaggtttgggttcaccaggtgccagcaggtcccacgatgctgcatttcttacgagctcctggaggatgcagatggtcctggtcagaggctgcattctgagtatcaggagccatggggcaacgtttctgcgattgaggaaggggcatttctggggtgggcagaacaaaggtctttggctgagctggagcatccgcctccatcagtgttttccggcaactgtactatccatcgtcttcccttcccacagctgaccatggctttggaaaatgctctgaaactttcttttcagaagagttgactcccaactccacacttaggggaagtcaagcctacttctcagaattcagagaaggcataaaaaagaattcatttctaaaggccctttagaagtaacttcaggtctgacagcggccagctaatttctggtcgccttccaggaatcttctgactgcaaaaaaaaagcatttaccacctgaacacaaacccagttacagatagaaaaacatagtcatttaaatagaatataagcatctggcctctgcccatcataatggagtaacacaaaaatctattttcaaaaggaaactaaatattattgaccaaaacatgaatggggagacctcagggtgatacagctcttgcctggatggaatttgtaatcaagaggatgagacaggattgtaacttgtgccaatgtgaaagggtttgctcaggtatcattcattttgcttaaatgcatgggtaatttccaaagttctttggagctgaatttcacaatttagtgcaggtcctggtgagcccaccttgacttatctcacagtacaatgcagtggcgtggctacaatgctgggcaagagaagccaatgtcaacagcccaggagtggctgggtccttaccaggctcccaggcatgcttcatggtgggccctgggctgggaggaacagcacctttgcctggtccatgagtatctgggtcaaactctcctgtggacacagaaggccatggcgacaggcattcccaggaaaagaaaagggcagcagctgaaatcgtcaggtggagaaggcagtcatccttgctcagtcaactctaatccggctgcctcctcctcagcttcagggtgaacctctcctaagctgtgtctttggtatctgatgggcattaggtgctggtgaaaaagctggagggtcctttgggatattacagaagcccaatctagccttgtattcaatatctaggcactctcacccctgaagttctacgtttccagatttctgaaaacatgggaaagcatgtgtgtgatgtctgaggtccccctcagcctctggtgtagggttaggagggctctaaagggtggcagctccagtgtcccagtggggcctgaagttggtcccttcccttcccagctcccatccatggtttagcccaatcccttccgtacctaagagtactgcacatggatgctccacgcagagcctctgctccactcccaggaagtg

SEQ ID NO: 10 - DNA, 1167 bp, Artificial Sequence
  sequence of STAR10
  misc_feature (452)..(452): the 'n' at position 452 may be any nucleic acid
  misc_feature (1143)..(1143): the 'n' at position 1143 may be any nucleic acid
aggtcaggagttcaagaccagcctggccaacatggtgaaaccctgtccctacaaaaaatacaaaaattagccgggcgtggtggggggcgcctataatcccagctactcaggatgctgagacaggagaattgtttgaacccgggaggtggaggttgcagtgaactgagatcgcgccactgcactccagcctggtgacagagagagactccgtctcaacaacagacaaacaaacaaacaaacaacaacaaaaatgtttactgacagctttattgagataaaattcacatgccataaaggtcaccttctacagtatacaattcagtggatttagtatgttcacaaagttgtacgttgttcaccatctactccagaacatttacatcacccctaaaagaagctctttagcagtcacttctcattctccccagcccctgccaaccacgaatctactntctgtctctattctgaatatttcatataaaggagtcctatcatatgggccttttacgtctaccttctttcacttagcatcatgtttttaagattcatccacagtgtagcacgtgtcagttaattcatttcatcttatggctggataatgctctattgtatgcatatccctcactttgcttatccattcatcaactgattgacatttgggttatttctactttttgactattatgagtaatgctgctatgaacattcctgtaccaatcgttacgtggacatatgctttcaattctcctgagtatgtaactagggttggagttgctgggtcatatgttaactcagtgtttcatttttttgaagaactaccaaatggttttccaaagtggatgcaacactttacattcccaccagcaagatatgaaggttccaatgtctctacatttttgccaacacttgtgattttcttttatttatttatttatttatttatttttgagatggagtctcactctgtcacccaggctggagtgcagtggcacaatttcagctcactgcaatctccacctctcgggctcaagcgatactcctgcctcaacctcccgagtaactgggattacaggcgcccaccaccacaccaagctaattttttgtatttttagtagagacggggtttcatcatgtcggccaggntgtactcgaactctgacctcaagt

SEQ ID NO: 11 - DNA, 1377 bp, Artificial Sequence
  sequence of STAR11
gattctgggtgggtttgatgatctgagagtcccttgaataaaaagaattctagaaaagctgtgaaacttcacctttcccctattcttaaccttacttgcctttgggaggctgaggcaggaggatgacttaaggccaggagtttgagaatgtagtgagctatgaccacaccggttacactcaagcctgggcgagaccacaacaaaaaccttacctgccaactgctccatgctggaaatttatttcgtttcttggattgtggaaagaactggcttactgaaaaccacacttctctaaaacccttcttccagttaggtgttaagattttaacagcctttcctatctgaataaaaactgcacacaaagtaaacttaagagatgtcaacaactcatctgtttgttacaagatgagtctccatgcttcatcgcctgtggggaatcctcatcagcgtctagtggcaaagactcctgtgtgctcaccgaaacgctccccttcctccagggcacacagtcacatggatttcccatgcaccctggcagctcagcaggagtccatgacttaagaaggccaatggactgtgggtgaagtctgtggacggggaagccacatgcgtcacttccaggcctgggcgtgtgcatcctccactctcttcccctgtgggtgcagaaggcggggcagagggccctgaaaccttggaggtcggtggagcccaaaatgaaggagcgtgggcctctgggtcttcatgtaaatttaggtaacactgaactgtcaggtgaacaagaaataaacgtcaaatgtattcagtcgattagatttggtgatggttgttacagcggttaccctccctcaacataataaattttcaaacaactcataatggctcactcatgtataaaatattccatatgaaatcccgggataacatgcttattctagctcaagcttaatcagagtagtccatctgagggaggagatagtagagggcagcaaggggttgtcactgaagataactagccttgctaaaagaatggttgaagaagtgagctacagatagggtaaatccacatctcagacattctgtgatggtcctgatattatcctaaagtaaaatgtagagttgaaccattttaattagattctagaattctattaatttataagatgggcatttccacaaaggactaaacaaagtacaagaggattaaataatcatccacatgggaggcaccgccttgcactttaaaatgatggagcttatcaagactggctgtggatatctgtccctgggagggttttttcccccatttttttcctttttgagacatgttctcgctatgttgcccaggctggtcttgaactcctgggctcaagtgatcct

SEQ ID NO: 12 - DNA, 1051 bp, Artificial Sequence
  sequence of STAR12
atcctgcttctgggaagagagtggcctcccttgtgcaggtgactttggcaggaccagcagaaacccaggtttcctgtcaggaggaagtgctcagcttatctctgtgaagggtcgtgataaggcacgaggaggcaggggcttgccaggatgttgcctttctgtgccatatgggacatctcagcttacgttgttaagaaatatttggcaagaagatgcacacagaatttctgtaacgaataggatggagttttaagggttactacgaaaaaaagaaaactactggagaagagggaagccaaacaccaccaagtttgaaatcgattttattggacgaatgtctcactttaaatttaaatggagtccaacttccttttctcacccagacgtcgagaaggtggcattcaaaatgtttacacttgtttcatctgcctttttgctaagtcctggtcccctacctcctttccctcacttcacatttgtcgtttcatcgcacacatatgctcatctttatatttacatatatataatttttatatatggcttgtgaaatatgccagacgagggatgaaatagtcctgaaaacagctggaaaattatgcaacagtggggagattgggcacatgtacattctgtactgcaaagttgcacaacagaccaagtttgttataagtgaggctgggtggtttttattttttctctaggacaacagcttgcctggtggagtaggcctcctgcagaaggcattttcttaggagcctcaacttccccaagaagaggagagggcgagactggagttgtgctggcagcacagagacaagggggcacggcaggactgcagcctgcagaggggctggagaagcggaggctggcacccagtggccagcgaggcccaggtccaagtccagcgaggtcgaggtctagagtacagcaaggccaaggtccaaggtcagtgagtctaaggtccatggtcagtgaggctgagacccagggtccaatgaggccaaggtccagagtccagtaaggccgagatccagggtccagggaggtcaag

SEQ ID NO: 13 - DNA, 1291 bp, Artificial Sequence
  sequence of STAR13
ctgccctgatcccttaatgcttttggcccagagcaccccgctaagtccaaccccagaggggcctcatccgcaaagcctcgggaagaggacagtgacggaggcggctgccctgtgagctgcacggggcagaatgtccttttggcgtcatgttggatgtccacacatccatatggggtcagttctattaggattccttcgggaagaggtagagggtaggaggggttaagccacgagacgaggcatgcagaggggtggcctggatgggtctgcactgctgtccatgcacacggggagcgttgcaaattgtgcttcccagcccatagtgcccccacagaggagcccgggagtccctggtgggcgtctgtgttcctgcaaggagccagtggagatggccccgtgaactctcatcccccttgccttggtggggtctctggcaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggct

SEQ ID NO: 14 - DNA, 711 bp, Artificial Sequence
  sequence of STAR14
agcaaggaccagggctctgcctccccagtcagcatgagcagagcagactcctttgagcagagcatcagggcagaaatagaacagtttctgaatgagaaaagacagcatgagacccaaaaatgtgatgggtcagtggagaagaaaccagacacacatgaaaattcggcgaagtcactctcgaaatcccaccaagagccggctacaaaggtggtgcaccggcagggcctgatgggcgtccagaaggagttcgccttctgcagacctcccccggttagcaaagacaaacgtgcagcccagaagcctcaggtccaaggtcacgaccacgaccacgcaggagaaggagggcagcacaaagccagcaacccccaccgcccttcagaagcagtacagaataaaagtgggattaaaaggaacgccagcaccgcaaggaggggaaagcgagtcacgagcgccgtacaggcgcccgaggcgtccgactccagcagcgacgacggcattgaggaggccatccagctgtaccaggtgcagaaaacacacaaggaggccgacggggacccgccccagagggtccagctccaagaggaaagagcacctgcccctcccgcacacagcacaagcagcgccacaaaaagtgccttgccagagacccacaggaaaacacccagcaagaagaagccagtgcccaccaagaccacggaccctggtccaggg

SEQ ID NO: 15 - DNA, 1876 bp, Artificial Sequence
  sequence of STAR15
cagtacatgcagaactgagtccaaacgagacggacagcaaacccggcagtgggctcccagacattcctgggggaaagggatcctaaccacaggcagttaaagtcatctcctccaaccctctatgacacaggctgtgcgctgtcatttaaaagctgagtgaaatttaacccttttcccatttagaaaaacaaagcgcagctggctgccagcactcatttaattttacataaacgtgctctttgaggctgaagcaaatctgactgattttcaatgtgaaaataaaatgtaaaaactgttcttggaattatttctaaacagaacatcagaatcgtctgaatcatcagaatcggctattttggaaaaatcggattcatcaaacgaatcttcggccaacaactgttagagaacgatgttaacaccacgcataggaatgttacattttctagaatttgacattttcattgacggaaaattactgtatcttgtatatggaaataccactactaaaaacataatgctataaatagaatgatgtcttttgtttccaaagtcaatatactcgagcaatgcaaaaataataataaaagtgagatacttcatggcaaagctgccgcaggataaacattgcagccacaagtgcccccagtattctcggggcaaactggaaaagggctaacaggcaacattttcatgttattctactgagtgcagtaattatttttaaaaatatacatgaataatgaaaaaactgtggtatggttttaaagaaatttccataacctggtgaaactcttcacacagggtaataggttcataaagccttggtcctctgcaaaacaagcatcaacttgacaatgactaaaagaagcaacagcaaaactgtcacgcatttggagccatggcctgggttgggccggtgtaaagctctccgccctctggagcaagtctgggccccagcggctggcatgtgggcactgcagggcctgggttgggcaggtgtgcagctctccgtcatctgagcctagtctgaggcctggtggctggcacgtgggccctgcagggcctctacttctcaccccagctccacttccctccctgccctcactgggtctcacagagccaatgaacactggggtcagattcagggcccagcatccactgcagtgggcactgcccttccacaaggcctggctccaggaagcaacccccacctcagccacacagtagggcaacaggaaatcccattcccccatgccagtgactacaccagggaaggggctcacgtgaggctggccccaggcctgctgtgagaccgcgttgtctatgagcttggatttaaggaacttgggagcaagaagctttctttcattacgggccaccagcagggaaaaaagttagcccaacgcagttgacagtcacacccccaccaggaccccagggcacagaaggagggaagaggacaacagaggatgaggtggggccagcagagggacagagaagagctgcctgccctggaacaggcagaaagcatcccacgtgcaagaaaaagtaggccagctagacttaaaatcagaactaccgctcatcaaaagatagtgtaacatttggggtgctataattttaacatgtcccccaaaaggcatgtgttggaaatttaatccccaacaaaccagggctgggaggtggagcctcatgagaggtggtgaggccatgagggtggagtgaatggatgaatgccattgtctcgggaatgggcctcttctacaaggacgagttcagcccccctttctcttgctcaccctctctttgccctttcgctagggagtgacgtaacaagaaggccctcacaagatgctggcaccttgatcttggactc

SEQ ID NO: 16 - DNA, 1282 bp, Artificial Sequence
  sequence of STAR16
cgcccacctcggctttccaaagtgctgggattacaggcatgagtcactgcgcccatcctgattccaagtctttagataataacttaactttttcgaccaattgccaatcaggcaatctttgaatctgcctatgacctaggacatccctctccctacaagttgccccgcgtttccagaccaaaccaatgtacatcttacatgtattgattgaagttttacatctccctaaaacatataaaaccaagctatagtctgaccacctcaggcacgtgttctcaggacctccctggggctatggcatgggtcctggtcctcagatttggctcagaataaatctcttcaaatattttccagaattttactcttttcatcaccattacctatcacccataagtcagagttttccacaaccccttcctcagattcagtaatttgctagaatggccaccaaactcaggaaagtattttacttacaattaccaatttattatgaagaactcaaatcaggaatagccaaatggaagaggcatagggaaaggtatggaggaaggggcacaaagcttccatgccctgtgtgcacaccaccctctcagcatcttcatgtgttcaccaactcagaagctcttcaaactttgtcatttaggggtttttatggcagttccactatgtaggcatggttgataaatcactggtcatcggtgatagaactctgtctccagctcctctctctctcctccccagaagtcctgaggtggggctgaaagtttcacaaggttagttgctctgacaaccagcccctatcctgaagctattgaggggtcccccaaaagttaccttagtatggttggaagaggcttattatgaataacaaaagatgctcctatttttaccactagggagcatatccaagtcttgcgggaacaaagcatgttactggtagcaaattcatacaggtagatagcaatctcaattcttgccttctcagaagaaagaatttgaccaagggggcataaggcagagtgagggaccaagataagttttagagcaggagtgaaagtttattaaaaagttttaggcaggaatgaaagaaagtaaagtacatttggaagagggccaagtgggcgacatgagagagtcaaacaccatgccctgtttgatgtttggcttggggtcttatatgatgacatgcttctgagggttgcatccttctcccctgattcttcccttggggtgggctgtccgcatgcacaatggcctgccagcagtagggaggggccgcatg

SEQ ID NO: 17 - DNA, 793 bp, Artificial Sequence
  sequence of STAR17
atccgaggggaggaggagaagaggaaggcgagcagggcgccggagcccgaggtgtctgcgagaactgttttaaatggttggcttgaaaatgtcactagtgctaagtggcttttcggattgtcttatttattactttgtcaggtttccttaaggagagggtgtgttgggggtgggggaggaggtggactggggaaacctctgcgtttctcctcctcggctgcacagggtgagtaggaaacgcctcgctgccacttaacaatccctctattagtaaatctacgcggagactctatgggaagccgagaaccagtgtcttcttccagggcagaagtcacctgttgggaacggcccccgggtccccctgctgggctttccggctcttctaggcggcctgatttctcctcagccctccacccagcgtccctcagggacttttcacacctccccacccccatttccactacagtctcccagggcacagcacttcattgacagccacacgagccttctcgttctcttctcctctgttccttctctttctcttctcctctgttccttctctttctctgtcataatttccttggtgctttcgccaccttaaacaaaaaagagaaaaaaataaaataaaaaaaacccattctgagccaaagtattttaagatgaatccaagaaagcgacccacatagccctccccacccacggagtgcgccaagacgcacccaggctccatcacagggccgagagcagcgccactctggtcgtacttttgggtcaagagatcttgcaaaagagg

SEQ ID NO: 18 - DNA, 492 bp, Artificial Sequence
  sequence of STAR18
atctttttgctctctaaatgtattgatgggttgtgttttttttcccacctgctaataaatattacattgcaacattcttccctcaacttcaaaactgctgaactgaaacaatatgcataaaagaaaatcctttgcagaagaaaaaaagctattttctcccactgattttgaatggcacttgcggatgcagttcgcaaatcctattgcctattccctcatgaacattgtgaaatgaaacctttggacagtctgccgcattgcgcatgagactgcctgcgcaaggcaagggtatggttcccaaagcacccagtggtaaatcctaacttattattcccttaaaattccaatgtaacaacgtgggccataaaagagtttctgaacaaaacatgtcatctttgtggaaaggtgtttttcgtaattaatgatggaatcatgctcatttcaaaatggaggtccacgatttgtggccagctgatgcctgcaaattatcct

SEQ ID NO: 19 - DNA, 1840 bp, Artificial Sequence
  sequence of STAR19
tcacttcctgatattttacattcaaggctagctttatgcatatgcaacctgtgcagttgcacagggctttgtgttcagaaagactagctcttggtttaatactctgttgttgccatcttgagattcattataatataatttttgaatttgtgttttgaacgtgatgtccaatgggacaatggaacattcacataacagaggagacaggtcaggtggcagcctcaattccttgccacccttttcacatacagcattggcaatgccccatgagcacaaaatttgggggaaccatgatgctaagactcaaagcacatataaacatgttacctctgtgactaaaagaagtggaggtgctgacagcccccagaggccacagtttatgttcaaaccaaaacttgcttagggtgcagaaagaaggcaatggcagggtctaagaaacagcccatcatatccttgtttattcatgttacgtccctgcatgaactaatcacttacactgaaaatattgacagaggaggaaatggaaagatagggcaacccatagttctttttccttttagtctttccttatcagtaaaccaaagatagtattggtaaaatgtgtgtgagttaattaatgagttagttttaggcagtgtttccactgttggggtaagaacaaaatatataggcttgtattgagctattaaatgtaaattgtggaatgtcagtgattccaagtatgaattaaatatccttgtatttgcatttaaaattggcactgaacaacaaagattaacagtaaaattaataatgtaaaagtttaatttttacttagaatgacattaaatagcaaataaaagcaccatgataaatcaagagagagactgtggaaagaaggaaaacgtttttattttagtatatttaatgggactttcttcctgatgttttgttttgttttgagagagagggatgtgggggcagggaggtctcattttgttgcccaggctggacttgaactcctgggctccagctatcctgccttagcttcttgagtagctgggactacaggcacacaccacagtgtctgacattttctggattttttttttttttttattttttttgtgagacaggttctggctctgttactcaggttgcagtgcagtggcatgatagcggctcactgcagcctcaacctcctcagcttaagctactctcccacttcagcctcctgagtagccaggactacagttgtgtgccaccacacctgtggctaatttttgtagagatggggtctctccacgttgccgaggctggtctccaactcctggtctcaagcgaacctcctgacttggcctcccgaagtgctgggattacaggcttgagccactgcatccagcctgtcctctgtgttaaacctactccaatttgtctttcatctctacataaacggctcttttcaaagttcccatagacctcactgttgctaatctaataataaattatctgccttttcttacatggttcatcagtagcagcattagattgggctgctcaattcttcttggtatattttcttcatttggcttctggggcatcacactctctttgagttactcattcctcattgatagcttcttcctagtcttctttactggttcttcctcttctccctgactccttaatattgtttttctccccaggctttagttcttagtcctcttctgttatctatttacacccaattctttcagagtctcatccagagtcatgaacttaaacctgtttctgtgcagataattcacattattatatctccagcccagactctcccgcaaactgcagactgatcctactg

SEQ ID NO: 20 - DNA, 780 bp, Artificial Sequence
  sequence of STAR20
gatctcaagtttcaatatcatgttttggcaaaacattcgatgctcccacatccttacctaaagctaccagaaaggctttgggaactgtcaacagagctacagaaaagtcagtaaagaccaatggacccctcaaacaaaaacagccaagcttttctgccaaaaagatgactgagaagactgttaaagcaaaaaactctgttcctgcctcagatgatggctatccagaaatagaaaaattatttcccttcaatcctctaggcttcgagagttttgacctgcctgaagagcaccagattgcacatctccccttgagtgaagtgcctctcatgatacttgatgaggagagagagcttgaaaagctgtttcagctgggccccccttcacctttgaagatgccctctccaccatggaaatccaatctgttgcagtctcctttaagcattctgttgaccctggatgttgaattgccacctgtttgctctgacatagatatttaaatttcttagtgctttagagtttgtgtatatttctattaataaagcattatttgtttaacagaaaaaaagatatatacttaaatcctaaaataaaataaccattaaaaggaaaaacaggagttataactaataagggaacaaaggacataaaatgggataataatgcttaatccaaaataaagcagaaaatgaagaaaaatgaaatgaagaacagataaatagaaaacaaatagcaatatgaaagacaaacttgaccgggtgtggtggctgatgcctgtaatcc

SEQ ID NO: 21 - DNA, 607 bp, Artificial Sequence
  sequence of STAR21
gatcaataatttgtaatagtcagtgaatacaaaggggtatatactaaatgctacagaaattccattcctgggtataaatcctagacatatttatgcatatgtacaccaagatatatctgcaagaatgttcacagcaaatctctttgtagtagcaaaaggccaaaaggtctatcaacaagaaaattaatacattgtggcacataatggcatccttatgccaataaaaatggatgaaattatagttaggttcaaaaggcaagcctccagataatttatatcatataattccatgtacaacattcaacaacaagcaaaactaaacatatacaaatgtcagggaaaatgatgaacaaggttagaaaatgattaatataaaaatactgcacagtgataacatttaatgagaaaaaaagaaggaagggcttagggagggacctacagggaactccaaagttcatggtaagtactaaatacataatcaaagcactcaaaatagaaaatattttagtaatgttttagctagttaatatcttacttaaaacaaggtctaggccaggcacggtggctcacacctgtaatcccagcactttgggaggctgaggcgggt

SEQ ID NO: 22 - DNA, 1380 bp, Artificial Sequence
  sequence of STAR22
cccttgtgatccacccgccttggcctcccaaagtgctgggattacaggcgtgagtcactacgcccggccaccctccctgtatattatttctaagtatactattatgttaaaaaaagtttaaaaatattgatttaatgaattcccagaaactaggattttacatgtcacgttttcttattataaaaataaaaatcaacaataaatatatggtaaaagtaaaaagaaaaacaaaaacaaaaagtgaaaaaaataaacaacactcctgtcaaaaaacaacagttgtgataaaacttaagtgcctgaaaatttagaaacatccttctaaagaagttctgaataaaataaggaataaaataatcacatagttttggtcattggttctgtttatgtgatggattatgtttattgatttgtgtatgttgaacttatctcaatagatgcagacaaggccttgataaaagtttttaacaccttttcatgttgaaaactctcaatagactaggtattgatgaaacatatctcaaaataatagaagctatttatgataaacccatagccaatatcatactgagtgggcaaaagctggaagcattccctttgaaaactggcacaagacaaggatgccctctctcaccactcctattaaatgtagtattggaagttctggccagagcaatcaggcaggagaaagaaaaggtattaaaataggaagagaggaagtcaaattgtctctgtttgcagtaaacatgattgtatatttagaaaaccccattgtctcatcctaaaaactccttaagctgataaacaacttcagcaaagtctcaggatacaaaatcaatgtgcaaaaatcacaagcattcctatacaccgataatagacagcagagagccaaatcatgagtgaagtcccattcacaattgcttcaaagaaaataaaatacttaggaatacaactttcacgggacatgaaggacattttcaaggacaactaaaaaccactgctcaaggaaatgagagaggacacaaagaaatggaaaaacattccatgctcatggaagaatcaatatcatgaaaatggccatactgcccaaagtaatttatagattcaatgctaaccccatcaagccaccattgactttcttcacagaactagaaaaaaactattttaaaactcatatgtagtcaaaaagagtcggtatagccaagacaatcctaagcataaagaacaaagctggatgcatcacgctgacttcaaaccatactacaaggctacagtaaccaaaacagcatggtactggtaccaaaacagatagatagaccgatagaacagaacagaggcctcggaaataacaccacacatctacaaccctttgatcttcaa

SEQ ID NO: 23 - DNA, 1246 bp, Artificial Sequence
  sequence of STAR23
atcccctcatccttcagggcagctgagcagggcctcgagcagctgggggagcctcacttaatgctcctgggagggcagccagggagcatggggtctgcaggcatggtccagggtcctgcaggcggcacgcaccatgtgcagccgcccccacctgttgctctgcctccgccacctggccatgggcttcagcagccagccacaaagtctgcagctgctgtacatggacaagaagcccacaagcagctagaggaccttgtgttccacgtgcccagggagcatggcccacagcccaaagaccagtcaggagcaggcaggggcttctggcaggcccagctctacctctgtcttcacacagatgggagatttctgttgtgattttgagtgatgtgcccctttggtgacatccaagatagttgctgaagcaccgctctaacaatgtgtgtgtattctgaaaacgagaacttctttattctgaaataattgatgcaaaataaattagtttggatttgaaattctattcatgtaggcatgcacacaaaagtccaacattgcatatgacacaaagaaaagaaaaagcttgcattccttaaatacaaatatctgttaactatatttgcaaatatatttgaatacacttctattatgttacatataatattatatgtatatgtatatataatatacatatatatgttacatataatatacttctattatgttacatataatatttatctataagtaaatacataaatataaagatttgagtagctgtagaacattgtcttatgtgttatcagctactactacaaaaatatctcttccacttatgccagtttgccatataaatatgatcttctcattgatggcccagggcaagagtgcagtgggtacttattctctgtgaggagggaggagaaaagggaacaaggagaaagtcacaaagggaaaactctggtgttgccaaaatgtcaagtttcacatattccgagacggaaaatgacatgtcccacagaaggaccctgcccagctaatgtgtcacagatatctcaggaagcttaaatgatttttttaaaagaaaagagatggcattgtcacttgtttcttgtagctgaggctgtgggatgatgcagatttctggaaggcaaagagctcctgctttttccacaccgagggactttcaggaatgaggccagggtgctgagcactacaccaggaaatccctggagagtgtttttcttactta

SEQ ID NO: 24 - DNA, 939 bp, Artificial Sequence
  sequence of STAR24
acgaggtcacgagttcgagaccagcctggccaagatggtgaagccctgtctctactaaaaatacaacaagtagccgggcgcggtgacgggcgcctgtaatcccagctactcaggaggctgaagcaggagaatctctagaacccaggaggcggaggtgcagtgagctgagactgccccgctgcactctagcctgggcaacacagcaagactctgtctcaaataaataaataaataaataaataaataaataaataaataaatagaaagggagagttggaagtagatgaaagagaagaaaagaaatcctagatttcctatctgaaggcaccatgaagatgaaggccacctcttctgggccaggtcctcccgttgcaggtgaaccgagttctggcctccattggagaccaaaggagatgactttggcctggctcctagtgaggaagccatgcctagtcctgttctgtttgggcttgatcctgtatcacttgattgtctctcctggactttccatggattccagggatgcaactgagaagtttatttttaatgcacttacttgaagtaagagttattttaaaacattttagcaaaggaaatgaattctgacaggttttgcactgaagacattcacatgtgaggaaaacaggaaaaccactatgctagaaaaagcaaatgctgttgagattgtctcacaaacacaaattgcgtgccagcaggtaggtttgagcctcaggttgggcacattttaccttaagcgcactgttggtggaacttaaggtgactgtaggacttatatatacatacatacatataatatatatacatatttatgtgtatatacacacacacacacacacacacacacagggtcttgctatcttgcccagggtggtctccaactctgggtctcaagcgatcctctgcctccccttcccaaag

SEQ ID NO: 25 - DNA, 1067 bp, Artificial Sequence
  sequence of STAR25
ataaaaaaataaaaaaccctgctctaatttgcaaaggctctatctttcctcccaaccacctgaaattttagtgaaaacggggcttcctgtaggaaggagtagctagctatcccggtccgctacaggttatcagtgcgtgaataccctgactcctaaggctcaggatttgactgggtcgcctcgtccgactgccccgcccccaacgcggacccacgtcaccgcgcgccagcctgcggccgtcctgacctcgcgggatttgagcttcggtgccaacaaacactcccaccgcggctgcgtccactttacctgccggcggcgaccagcttctgaagaaaagtgtccaccatggtgtcgaggagcttcaccctcgaaatggtagtgccgggtggcacagattccgaagacgacccctcatgccttttttcctcacagccgctgcctagattggcgctacttgcttcggccatgttgaagttgaacctccaaatctaactggcccggcctccccgcctgccggagctcccgattggccgctcccgcgaagggtgcctccgattggaagcagtagaacgtctgtcaccgagcagggcgggggcggggaagtcatcggaggctgagggcagcggggaggcgaggctctgcgcggtgggatgtccgcgaccggaaaaatacgcgcaagccaaagctcgggggctcaataaaaacttttaattacatttcagagacttcgtacagtgcaacagtgaatattcactgttaattttcacaagagtccatttcatcaaacgttcagagagtctgccttttcattcccttgttcctcagtgctccaatcaggtttccagtctcccagaggtttcttttagttttgattaccgaccaaaactccagtttagggagaatggaagtccaccgtcccatccccaccaaaacatatttcagtcaaacccaatcccagtccctaaagaattaggaaagtatgggccaagggtccttttaattatacacacatcacccttaaaactgcgtgtgtgtacgagaaataaagaaaaacacaagaggggctg

SEQ ID NO: 26 - DNA, 540 bp, Artificial Sequence
  sequence of STAR26
ccccctgacaagccccagtgtgtgatgttccccactctgtgtccatgcattctcattgttcaactcccatctgtgagtgagaacatgcagtgtttggttttctgtccttgagatagtttgctgagaatgatggtttccagcttcatccatgtccttgcaaaggaagtgaacttatccttttttatggcttcatagtattccatggcacatatgtgccacatttttttaatccagtctatcattgatggacatttgggttggttccaagtctttgctattgtgaatagcaccacaattaacatatgtgtgcatgtatacatctttatagtagcatgatttataatccttcgggtatataccctgtaatgggatcgctgggtcaaatggtatttctagttctagatccttgaggaatcaccacactgctttccacaatggttgaactaatttacgctcccaccagcagtgtaaaagcattcctatttctccacgtcctctccagtatctgttgtttcctgactttttaatgatcatcattct

SEQ ID NO: 27 - DNA, 1520 bp, Artificial Sequence
  sequence of STAR27
cttggccctcacaaagcctgtggccagggaacaattagcgagctgcttattttgctttgtatccccaatgctgggcataatgcctgccattatgagtaatgccggtagaagtatgtgttcaaggaccaaagttgataaataccaaagaatccagagaagggagagaacattgagtagaggatagtgacagaagagatgggaacttctgacaagagttgtgaagatgtactaggcagggggaacagcttaaggagagtcacacaggaccgagctcttgtcaagccggctgccatggaggctgggtggggccatggtagctttcccttccttctcaggttcagagtgtcagccttgaacttctaattcccagaggcatttattcaatgttttcttctaggggcatacctgccctgctgtggaagactttcttccctgtgggtcgccccagtccccagatgagacggtttgggtcagggccaggtgcaccgttgggtgtgtgcttatgtctgatgacagttagttactcagtcattagtcattgagggaggtgtggtaaagatggagatgctgggtcacatccctagagaggtgttccagtatgggcacatgggagggctggaaggataggttactgctagacgtagagaagccacatcctttaacaccctggcttttcccactgccaagatccagaaagtccttgtggtttcgctgctttctcctttttttttttttttttttttctgagatggagtctggctctgtcgcccaggctggagtgcagtggcacgatttcggctcactgcaagttccgcctcctaggttcataccattctcccacctcagcctcccgagtagctgggactacaggcgccaccacacccagctaattttttgtatttttagtagagacggcgtttcaccatgttagccaggatggtcttgatccgcctgcctcagcctcccaaagtgctgggattacaggcgtgagccaccgcgcccggcctgctttcttctttcatgaagcattcagctggtgaaaaagctcagccaggctggtctggaactcttgacctcaagtgatctgcctgcctcagcctcccaaagtgctgagattacaggcatgagccagtccgaatgtggctttttttgttttgttttgaaacaaggtctcactgttgcccaggctgcagtgcagtggcatacctcagctccactgcagcctcgacctcctgggctcaagcaatcctcccaactgagcctccccagtagctggggctacaagcgcatgccaccacgcctggctatttttttttttttttttttttttgagaaggagtttcattcttgttgcccaggctggagtgcaatggcacagtctcagctcactgcagcctccgcctcctgggttcaagcgattctcctgcctcagcctcccgagtagctgggattataggcacctgccaccatgcctggctaatttttttgtatttttagtagggatggggtttcaccatgtt

SEQ ID NO: 28 - DNA, 961 bp, Artificial Sequence
  sequence of STAR28
aggaggttattcctgagcaaatggccagcctagtgaactggataaatgcccatgtaagatctgtttaccctgagaagggcatttcctaactctccctataaaatgccaagtggagcaccccagatgaaatagctgatatgctttctatacaagccatctaggactggctttatcatgaccaggatattcacccactgaatatggctattacccaagttatggtaaatgctgtagttaagggggtcccttccacatggacaccccaggttataaccagaaagggttcccaatctagactccaagagagggttcttagacctcatgcaagaaagaacttggggcaagtacataaagtgaaagcaagtttattaagaaagtaaagaaacaaaaaaatggctactccataagcaaagttatttctcacttatatgattaataagagatggattattcatgagttttctgggaaaggggtgggcaattcctggaactgagggttcctcccacttttagaccatatagggtatcttcctgatattgccatggcatttgtaaactgtcatggcactgatgggagtgtcttttagcattctaatgcattataattagcatataatgagcagtgaggatgaccagaggtcacttctgttgccatattggtttcagtggggtttggttggcttttttttttttttaaccacaacctgttttttatttatttatttatttatttatttatttatattttttatttttttttagatggagtcttgctctgtcacccaggttagagtgcagtggcaccatctcggctcactgcaagctctgcctccttggttcacgccattctgctgcctcagcctcccgagtagctgggactacaggtgcctgccaccatacccggctaattttttctatttttcagtagagacggggtttcaccgtgttagccaggatggtc

SEQ ID NO: 29 - DNA, 2233 bp, Artificial Sequence
  sequence of STAR29
agcttggacacttgctgatgccactttggatgttgaagggccgccctctcccacaccgctggccacttttaaatatgtcccctctgcccagaagggccccagaggaggggctggtgagggtgacaggagttgactgctctcacagcagggggttccggagggaccttttctccccattgggcagcatagaaggacctagaagggccccctccaagcccagctgggcgtgcagggccagcgattcgatgccttcccctgactcaggtggcgctgtcctaaaggtgtgtgtgttttctgttcgccagggggtggcggatacagtggagcatcgtgcccgaagtgtctgagcccgtggtaagtccctggagggtgcacggtctcctccgactgtctccatcacgtcaggcctcacagcctgtaggcaccgctcggggaagcctctggatgaggccatgtggtcatccccctggagtcctggcctggcctgaagaggaggggaggaggaggccagcccctccctagccccaaggcctgcgaggctgcaagcccggccccacattctagtccaggcttggctgtgcaagaagcagattgcctggccctggccaggcttcccagctaggatgtggtatggcaggggtgggggacattgaggggctgctgtagcccccacaacctccccaggtagggtggtgaacagtaggctggacaagtggacctgttcccatctgagattcaagagcccacctctcggaggttgcagtgagccgagatccctccactgcactccagcctgggcaacagagcaagactctgtctcaaaaaaacagaacaacgacaacaaaaaacccacctctggcccactgcctaactttgtaaataaagttttattggcacatagacacacccattcatttacatactgctgcggctgcttttgcattacccttgagtagacgacagaccacgtggccatggaagccaaaaatatttactgtctggccctttacagaagtctgctctagagggagaccccggcccatggggcaggaccactgggcgtgggcagaagggaggcctcggtgcctccacgggcctagttgggtatctcagtgcctgtttcttgcatggagcaccaggggtcagggcaagtacctggaggaggcaggctgttgcccgcccagcactgggacccaggagaccttgagaggctcttaacgaatgggagacaagcaggaccagggctcccattggctgggcctcagtttccctgcctgtaagtgagggagggcagctgtgaaggtgaactgtgaggcagagcctctgctcagccattgcaggggcggctctgccccactcctgttgtgcacccagagtgaggggcacggggtgagatgtcaccatcagcccataggggtgtcctcctggtgccaggtccccaagggatgtcccatcccccctggctgtgtggggacagcagagtccctggggctgggagggctccacactgttttgtcagtggtttttctgaactgttaaatttcagtggaaaattctctttccccttttactgaaggaacctccaaaggaagacctgactgtgtctgagaagttccagctggtgctggacgtcgcccagaaagcccaggtactgccacgggcgccggccaggggtgtgtctgcgccagccatgggcaccagccaggggtgtgtctacgccggccaggggtaggtctccgccggcctccgctgctgcctggggagggccgtgcctgacactgcaggcccggtttgtccgcggtcagctgacttgtagtcaccctgcccttggatggtcgttacagcaactctggtggttggggaaggggcctcctgattcagcctctgcggacggtgcgcgagggtggagctcccctccctccccaccgcccctggccagggttgaacgcccctgggaaggactcaggcccgggtctgctgttgctgtgagcgtggccacctctgccctagaccagagctgggccttccccggcctaggagcagccgggcaggaccacagggctccgagtgacctcagggctgcccgacctggaggccctcctggcgtcgcggtgtgactgacagcccaggagcgggggctgttgtaattgctgtttctccttcacacagaaccttttcgggaagatggctgacatcctggagaagatcaagaagtaagtcccgccccccaccc

SEQ ID NO: 30 - DNA, 1851 bp, Artificial Sequence
  sequence of STAR30
cctcccctggagccttcagaaggagcatggcataggagtcttgatttcagacgtctggtccccagaatgatgggagaatgaatttctgttatttaagccacccaacctgtggtgctttgttatagcagcctcaggaaactaacacactgcacgtgcccactattcccttttccagtatctttcaggacttgctggcttcctttgttctggcgtacacccatgcatggccccattccccacttcctaaaacaacaaccctgacttagtctgtttgggctgctagaacaaaatactatagactgggtgacttataaacaacagaaattcatttctcacattctggaggctgggaagtccaatatcgaggcaccatcacatttggtctctgctgaggcccccttcctagctcctcactgtgtccttacatggcagaaggggcaaggcagctctctggggtcccttttcaaggccacaaatcccattcattagggctgatgacttcatgacttaatcacctcctaatggccccacctcctaatcgcattgggcgttaggattcaacataaattttggggggacacacatattcagaccatagcaaaccccaacaataaaaaaccttcactttaaggttccaaatggactggcagttaaatcatgttcatatttacataaaagaaggagtaagtcaacaaattgataaacgcgtggagatttgttcggatggatgttcaccaaaatgctggccttaaagagtgagatgggaaatgggaactattacattcttcttcatactttttggtactgcctgcattgttaaaaaaaaaaaaaaagagcacagagcatttttacaatcaggaaaaaaacaatgaggttatcttcattctggaaaaaaatggaaaatgaaacagtggagtcacatcatggaaaatgcttatggtacaatttcatgtgacataaaacaatagaatagaggacctgttttatgactaaagcactgtaaaaatgacaggcctggaaggagagatgaaaaccactcatttgttaaggtagtcaggtggcaggtgatttctcttcttttgaaaatttccattttcattatatcgcagtttgtgcatttactaaaactttcggttggtacacatgcataaatagatagataaataagtagatagatgatagataaatagacggtaggtagatagatagatagatatgagaaataagtcccctgtacttggccttgcagccataactagtcattccccttcctctgtccattgctatgcctgatggacaaggcagtctgtgccctctggccccaattccaatgtgccctctgctcctggctgttagtccctttccaccccaatacaattgctccgaggtcacttctaagtgtgaagcccccagatcagatggcttcttctgtgtccttaccttacccaatttctaattataactaaaacacaatgaggctctagtaaaataccatgagacttcaggccctctgtataacttcactcatttaaacctaacaaggaaaacctaccatgaatccgaggcacagagcagctaaggaactcaccaaggtcacgcagctattggtgatggaaccatgagtcaagcttcacagcctgttggctctagaatagggtttcccaacctcagcactgtggacattttcaggctggataattctctgttgtggggggctgttctgtgccttgtaggatattaggagcatctctggcctctacccactagacgcagcagcactcccatgcccagttgtgacaacaagcaatgtctcccaccattgccaagtgtcccctgggtggaaatgcaccc

SEQ ID NO: 31 - DNA, 1701 bp, Artificial Sequence
  sequence of STAR31
  misc_feature (159)..(159): the 'n' at position 159 may be any nucleic acid
  misc_feature (1667)..(1667): the 'n' at position 1667 may be any nucleic acid
  misc_feature (1677)..(1677): the 'n' at position 1677 may be any nucleic acid
  misc_feature (1683)..(1684): the 'n' at position 1683-1684 may be any nucleic acid
  misc_feature (1686)..(1687): the 'n' at positions 1686-1687 may be any nucleic acid
  misc_feature (1690)..(1690): the 'n' at position 1690 may be any nucleic acid
  misc_feature (1693)..(1696): the 'n' at positions 1693-1696 may be any nucleic acid
cacccgccttggccccccagagtgctgggattacaagtgtaaaccaccattcctggctagatttaattttttaaaaaataaagagaagtaggaatagttcattttagggagagccccttaactgggacaggggcaggacaggggtgaggcttcccttanttcaagctcacctcaaacccacccaggactgtgtgtcacattctccaataaaggaaaggttgctgcccccgcctgtgagtgctgcagtggagggtagagggccgtgggcagagtgcttcatggactgctcatcaagaaaggcttcatgacaatcggcccagctgctgtcatcccacattctacttccagctaggagaaggcggcttgcccacagtcacccagccggcaagtgtcacccctgggttggacccagagctatgatcctgcccaggggtccagctgagaatcaggcccacgttctaggcagaggggctcacctactgggactccagtagctgtagtgcatggaggcatcatggctgcagcagcctggacctggtctcacactggctgtccctgtgggcaggccatcctcaatgccaggtcaggcccaagcatgtatcccagacaatgacaatggggtggaatcctctcttgtcccagaagccactcctcactgttctacctgaggaaggcaggggcatggtggaatcctgaagcctgctgtgagggtctccagcgaacttgcacatggtcagccctgccttctcctccctgaactagattgagcgagagcaagaaggacattgaaccagcacccaaagaattttggggaacggcctctcatccaggtcaggctcacctcctttttaaaatttaattaattaattaattaatttttttttagagacagagtcttactgtgtggcccaggctgtagtgcagtggcacaatcatagttcactgcagcctcaaactccccacctcagcctctggattagctgagactacaggtgcaccaccaccacacccagctaatatttttatttttgtagagagagggtttcaccatcttgcccaggctggtctcaaactcctgggctcaagtgatcccgcccaggtctgaaagcccccaggctggcctcagactgtggggttttccatgcagccacccgagggcgcccccaagccagttcatctcggagtccaggcctggccctgggagacagagtgaaaccagtggtttttatgaacttaacttagagtttaaaagatttctactcgatcacttgtcaagatgcgccctctctggggagaagggaacgtgactggattccctcactgttgtatcttgaataaacgctgctgcttcatcctgtgggggccgtggccctgtccctgtgtgggtggggcctcttccatttccctgacttagaaaccacagtccacctagaacagggtttgagaggcttagtcagcactgggtagcgttttgactccattctcggctttcttctttttctttccaggatttttgtgcagaaatggttcttttgttgccgtgttagtcctccttggaaggcagctcagaaggcccgtgaaatgtcgggggacaggacccccagggagggaaccccaggctacgcactttagggttcgttctccagggagggcgacctgacccccgnatccgtcggngcgcgnngnnacnaannnnttccc

SEQ ID NO: 32 - DNA, 771 bp, Artificial Sequence
  sequence of STAR32
gatcacacagcttgtatgtgggagctaggattggaaccccagaagtctggccccaggttcatgctctcacccactgcatacaatggcctctcataaatcaatccagtataaaacattagaatctgctttaaaaccatagaattagtagcgtaagtaataaatgcagagaccatgcagtgaatggcattcctggaaaaagcccccagaaggaattttaaatcagctttcgtctaatcttgagcagctagttagcaaatatgagaatacagttgttcccagataatgctttatgtctgaccatcttaaactggcgctgtttttcaaaaacttaaaaacaaaatccatgactcttttaattataaaagtgatacatgtctacttgggaggctgaggtggtgggaggatggcttgagtttgaggctgcagtatgctactatcatgcctataaatagccgctgcattccagcttgggcaacatacccaggccctatctcaaaaaaataaaaagtaatacatctacattgaagaaaattaattttattgggtttttttgcatttttattatacacagcacacacagcacatatgaaaaaatgggtatgaactcaggcattcaactggaagaacagtactaaatcaatgtccatgtagtcagcgtgactgaggttggtttgttttttcttttttcttctcttctcttctcttttctttttttttgagacggagctttgctctttttgcccaggcttgattgcaatggcgtgatctcag

SEQ ID NO: 33 - DNA, 1368 bp, Artificial Sequence
  sequence of STAR33
gcttttatcctccattcacagctagcctggcccccagagtacccaattctccctaaaaaacggtcatgctgtatagatgtgtgtggcttggtagtgctaaagtggccacatacagagctctgacaccaaacctcaggaccatgttcatgccttctcactgagttctggcttgttcgtgacacattatgacattatgattatgatgacttgtgagagcctcagtcttctatagcacttttagaatgctttataaaaaccatggggatgtcattatattctaacctgttagcacttctgttcgtattacccatcacatcccaacatcaattctcatatatgcaggtacctcttgtcacgcgcgtccatgtaaggagaccacaaaacaggctttgtttgagcaacaaggtttttatttcacctgggtgcaggtgggctgagtctgaaaagagagtcagtgaagggagacaggggtgggtccactttataagatttgggtaggtagtggaaaattacaatcaaagggggttgttctctggctggccagggtgggggtcacaaggtgctcagtgggagagcctttgagccaggatgagccagaaggaatttcacaaggtaatgtcatcagttaaggcagggactggccattttcacttcttttgtggtggaatgtcatcagttaaggcaggaaccggccattttcacttcttttgtgattcttcacttgcttcaggccatctggacgtataggtgcaggtcacagtcacaggggataagatggcaatggcatagcttgggctcagaggcctgacacctctgagaaactaaagattataaaaatgatggtcgcttctattgcaaatctgtgtttattgtcaagaggcacttatttgtcaattaagaacccagtggtagaatcgaatgtccgaatgtaaaacaaaatacaaaacctctgtgtgtgtgtgtgtgtgagtgtgtgtgtatgtgtgtgtgtgtgtattagagaggaaaagcctgtatttggaggtgtgattcttagattctaggttctttcctgcccaccccatatgcacccaccccacaaaagaacaaacaacaaatcccaggacatcttagcgcaacatttcagtttgcatattttacatatttacttttcttacatattaaaaaactgaaaattttatgaacacgctaagttagattttaaattaagtttgtttttacactgaaaataatttaatatttgtgaagaatactaatacattggtatatttcattttcttaaaattctgaacccctcttcccttatttccttttgacccgattggtgtattggtcatgtgactcatggatttgccttaaggcaggagg

SEQ ID NO: 34 - DNA, 755 bp, Artificial Sequence
  sequence of STAR34
actgggcaccctcctaggcaggggaatgtgagaactgccgctgctctggggctgggcgccatgtcacagcaggagggaggacggtgttacaccacgtgggaaggactcagggtggtcagccacaaagctgctggtgatgaccaggggcttgtgtcttcactctgcagccctaacacccaggctgggttcgctaggctccatcctgggggtgcagaccctgagagtgatgccagtgggagcctcccgcccctccccttcctcgaaggcccaggggtcaaacagtgtagactcagaggcctgagggcacatgtttatttagcagacaaggtggggctccatcagcggggtggcctggggagcagctgcatgggtggcactgtggggagggtctcccagctccctcaatggtgttcgggctggtgcggcagctggcggcaccctggacagaggtggatatgagggtgatgggtggggaaatgggaggcacccgagatggggacagcagaataaagacagcagcagtgctggggggcagggggatgagcaaaggcaggcccaagacccccagcccactgcaccctggcctcccacaagccccctcgcagccgcccagccacactcactgtgcactcagccgtcgatacactggtctgttagggagaaagtccgtcagaacaggcagctgtgtgtgtgtgtgcgtgtatgagtgtgtgtgtgtgatccctgactgccaggtcctctgcactgcccctggg

SEQ ID NO: 35 - DNA, 1193 bp, Artificial Sequence
  sequence of STAR35
  misc_feature (312)..(312): the 'n' at position 312 may be any nucleic acid
  misc_feature (355)..(355): the 'n' at position 355 may be any nucleic acid
  misc_feature (361)..(361): the 'n' at position 361 may be any nucleic acid
  misc_feature (367)..(367): the 'n' at position 367 may be any nucleic acid
  misc_feature (370)..(370): the 'n' at position 370 may be any nucleic acid
  misc_feature (383)..(383): the 'n' at position 383 may be any nucleic acid
  misc_feature (390)..(390): the 'n' at position 390 may be any nucleic acid
  misc_feature (399)..(399): the 'n' at position 399 may be any nucleic acid
  misc_feature (413)..(413): the 'n' at position 413 may be any nucleic acid
  misc_feature (417)..(417): the 'n' at position 417 may be any nucleic acid
  misc_feature (422)..(423): the 'n' at positions 422-423 may be any nucleic acid
  misc_feature (445)..(445): the 'n' at position 445 may be any nucleic acid
  misc_feature (576)..(576): the 'n' at position 576 may be any nucleic acid
  misc_feature (578)..(578): the 'n' at position 578 may be any nucleic acid
  misc_feature (580)..(580): the 'n' at position 580 may be any nucleic acid
  misc_feature (589)..(589): the 'n' at position 589 may be any nucleic acid
  misc_feature (624)..(624): the 'n' at position 624 may be any nucleic acid
  misc_feature (681)..(681): the 'n' at position 681 may be any nucleic acid
  misc_feature (702)..(702): the 'n' at position 702 may be any nucleic acid
  misc_feature (756)..(756): the 'n' at position 756 may be any nucleic acid
  misc_feature (761)..(761): the 'n' at position 761 may be any nucleic acid
  misc_feature (828)..(828): the 'n' at position 828 may be any nucleic acid
  misc_feature (845)..(845): the 'n' at position 845 may be any nucleic acid
  misc_feature (868)..(868): the 'n' at position 868 may be any nucleic acid
  misc_feature (880)..(881): the 'n' at positions 880-881 may be any nucleic acid
  misc_feature (923)..(923): the 'n' at position 923 may be any nucleic acid
  misc_feature (925)..(925): the 'n' at position 925 may be any nucleic acid
  misc_feature (1019)..(1019): the 'n' at position 1019 may be any nucleic acid
  misc_feature (1021)..(1021): the 'n' at position 1021 may be any nucleic acid
  misc_feature (1055)..(1055): the 'n' at position 1055 may be any nucleic acid
  misc_feature (1062)..(1063): the 'n' at positions 1062-1063 may be any nucleic acid
  misc_feature (1074)..(1074): the 'n' at position 1074 may be any nucleic acid
  misc_feature (1089)..(1089): the 'n' at position 1089 may be any nucleic acid
  misc_feature (1100)..(1101): the 'n' at positions 1100-1101 may be any nucleic acid
  misc_feature (1106)..(1107): the 'n' at positions 1106-1107 may be any nucleic acid
  misc_feature (1117)..(1117): the 'n' at position 1117 may be any nucleic acid
  misc_feature (1138)..(1138): the 'n' at position 1138 may be any nucleic acid
  misc_feature (1140)..(1140): the 'n' at position 1140 may be any nucleic acid
  misc_feature (1145)..(1146): the 'n' at positions 1145-1146 may be any nucleic acid
  misc_feature (1158)..(1159): the 'n' at positions 1158-1159 may be any nucleic acid
  misc_feature (1180)..(1180): the 'n' at position 1180 may be any nucleic acid
  misc_feature (1187)..(1188): the 'n' at positions 1187-1188 may be any nucleic acid
  misc_feature (1191)..(1191): the 'n' at position 1191 may be any nucleic acid
cgacttggtgatgcgggctcttttttggttccatatgaactttaaagtagtcttttccaattctgtgaagaaagtcattggtaggttgatggggatggcattgaatctgtaaattaccttgggcagtatggccattttcacaatgttgattcttcctatccatgatgatggaatgttcttccattagtttgtatcctcttttatttccttgagcagtggtttgtagttctccttgaagaggtccttcacatcccttgtaagttggattcctaggtattttattctctttgaagcaaattgtgaatgggagtncactcacgatttggctctctgtttgtctgctgggtgtataaanaatgtngtgatnttngtacattgatttngtatccntgagacttngctgaatttgcttnatcngcttnngggaaccttttgggctgaaacnatgggattttctaaatatacaatcatgtcgtctgcaaacagggaacaatttgacttcctcttttcctaattgaatacactttatctccttctcctgcctaattgccctgggcaaaacttccaacactatgntngnaataggagntggtgagagagggcatccctgttcttgttgccagnttttcaaagggaatgcttccagttttggcccattcagtatgatatgggctgtgggtngtgtcataaatagctcttatnattttgaaatgtgtcccatcaatacctaatttattgaaagtttttagcatgaangcatngttgaatttggtcaaaggctttttctgcatctatggaaataatcatgtggtttttgtctttggctcntgtttatatgctggatnacatttattgatttgtgtatatngaacccagcctnncatcccagggatgaagcccacttgatccaagcttggcgcgcngnctagctcgaggcaggcaaaagtatgcaaagcatgcatctcaattagtcagcacccatagtccgcccctacctccgcccatccgcccctaactcngnccgttcgcccattctcgcccatggctgactaatntttttannatccaagcggngccgccctgcttgancattcagagtnnagagnnttggaggccnagccttgcaaaactccggacngnttctnnggattgaccccnnttaaatatttggttttttgtnttttcannggnga

SEQ ID NO: 36 - DNA, 1712 bp, Artificial Sequence
  sequence of STAR36
gatcccatccttagcctcatcgatacctcctgctcacctgtcagtgcctctggagtgtgtgtctagcccaggcccatcccctggaactcaggggactcaggactagtgggcatgtacacttggcctcaggggactcaggattagtgagccccacatgtacacttggcctcagtggactcaggactagtgagccccacatgtacacttggcctcaggggactcaggattagtgagcccccacatgtacacttggcctcaggggactcaggattagtgagccccacatgtacacttggcctcaggggactcaggactagtgagccccacatgtacacttggcctcaggggactcagaactagtgagccccacatgtacacttggcttcaggggactcaggattagtgagccccacatgtacacttggacacgtgaaccacatcgatgtgctgcagagctcagccctctgcagatgaaatgtggtcatggcattccttcacagtggcacccctcgttccctccccacctcatctcccattcttgtctgtcttcagcacctgccatgtccagccggcagattccaccgcagcatcttctgcagcacccccgaccacacacctccccagcgcctgcttggccctccagcccagctcccgcctttcttccttggggaagctccctggacagacaccccctcctcccagccatggctttttcctgctctgccccacgcgggaccctgccctggatgtgctacaatagacacatcagatacagtccttcctcagcagccggcagacccagggtggactgctcggggcctgcctgtgaggtcacacaggtgtcgttaacttgccatctcagcaactagtgaatatgggcagatgctaccttccttccggttccctggtgagaggtactggtggatgtcctgtgttgccggccaccttttgtccctggatgccatttatttttttccacaaatatttcccaggtctcttctgtgtgcaaggtattagggctgcagcgggggccaggccacagatctctgtcctgagaagacttggattctagtgcaggagactgaagtgtatcacaccaatcagtgtaaattgttaactgccacaaggagaaaggccaggaaggagtggggcatggtggtgttctagtgttacaagaagaagccagggagggcttcctggatgaagtggcatctgacctgggatctggaggaggagaaaaatgtcccaaaagagcagagagcccaccctaggctctgcaccaggaggcaacttgctgggcttatggaattcagagggcaagtgataagcagaaagtccttgggggccacaattaggatttctgtcttctaaagggcctctgccctctgctgtgtgaccttgggcaagttacttcacctctagtgctttggttgcctcatctgtaaagtggtgaggataatgctatcacactggttgagaattgaagtaattattgctgcaaagggcttataagggtgtctaatactagtactagtaggtacttcatgtgtcttgacaattttaatcattattattttgtcatcaccgtcactcttccaggggactaatgtccctgctgttctgtccaaattaaacattgtttatccctgtgggcatctggcgaggtggctaggaaagcctggagctgtttcctgttgacgtgccagactagt

SEQ ID NO: 37 - DNA, 1321 bp, Artificial Sequence
  sequence of STAR37
atctctctctgccaaagcaacagcggtccctgccccaaccagactaccccactcagtggggttacggatgctgctccagcatcctaacactgcccagctggtgcctgcctgtgctcacccacaacccccaggccggccttccctgcagcctgggcttggccaccttggcctgattgagcactgaggcctcctgggcacccagccccatcactgcacctgctgcttccagccccaccccaccggctcaggggttcttcccagcggcgctgatcatgaagtcaacatgcacgcaagtcgtctcaggaaactttttaatgaaagtgtcggccacggtggtgtgtaggtggctgagctcagattgcagctgctaagacaccagccacttaccaagagaaagccaggctgcttcaaacccagggccggaggcaaaaaagcatcacttccagccggggagtctggaagccacgccttgtgggaggtcacactggcatctaggccttcgcctgcactgcagaaggagagccgggtccccctcctggagaacgctgcgttccccagccccacaccggctttgccaccacacaggctgttgaggcaggaggcgggtaagacgtagctgtagacccaaagcaaccaccagccctgggaccctgcgggagaggagcacttttagaacatggaaaaatgtggtcatcccatcattagacagcacacatcctacataaataaaaagtcgtatggggaaggaggttggggagggaataaaaaattggcacagacattgatagactggtttccagtttcaaggtaacagatgcacatcatgagaccagaggaggcagagacaagggctgaatttggcttttctaagcaacatgtgttcctgcgcagggctgaatggtcgctgagacagagatggaagccaggacaagggagcccaccgggcccagataggtacagagagcagaggctcctgttctgtcctcgccacccatgagggtgacactgcttgtaaatggtggctgtgctctcccagcaagaaaaaagcacaactaaatccacactgcacacagacgcagacagaaagccttcaagtggctctgttttctgctccctgccttgccaggtccacaagcagagaggagtgtcaggcacatggccccgctgtcaggctccccagtgagctgtaggctcagcaggagctgcccactgacacacaggggacacccactcctgccaccttgggagcggttgccagacagagccgcactgggtgctggtgtcatccagggaccccacacacttccttaaatgtgatcct

SEQ ID NO: 38 - DNA, 1445 bp, Artificial Sequence
  sequence of STAR38
  misc_feature (348)..(348): the 'n' at position 348 may be any nucleic acid
  misc_feature (888)..(888): the 'n' at position 888 may be any nucleic acid
  misc_feature (896)..(896): the 'n' at position 896 may be any nucleic acid
  misc_feature (949)..(949): the 'n' at position 949 may be any nucleic acid
gatctatgggagtagcttccttagtgagctttcccttcaaatactttgcaaccaggtagagaattttggagtgaaggttttgttcttcgtttcttcacaatatggatatgcatcttcttttgaaaatgttaaagtaaattacctctcttttcagatactgtcttcatgcgaacttggtatcctgtttccatcccagccttctataacccagtaacatcttttttgaaaccagtgggtgagaaagacacctggtcaggaacgcggaccacaggacaactcaggctcacccacggcatcagactaaaggcaaacaaggactctgtataaagtaccggtggcatgtgtatnagtggagatgcagcctgtgctctgcagacagggagtcacacagacacttttctataatttcttaagtgctttgaatgttcaagtagaaagtctaacattaaatttgattgaacaattgtatattcatggaatattttggaacggaataccaaaaaatggcaatagtggttctttctggatggaagacaaacttttcttgtttaaaataaattttattttatatatttgaggttgaccacatgaccttaaggatacatatagacagtaaactggttactacagtgaagcaaattaacatatctaccatcgtacatagttacatttttttgtgtgacaggaacagctaaaatctacgtatttaacaaaaatcctaaagacaatacatttttattaactatagccctcatgatgtacattagatcgtgtggttgtttcttccgtccccgccacgccttcctcctgggatggggattcattccctagcaggtgtcggagaactggcgcccttgcagggtaggtgccccggagcctgaggcgggnactttaanatcagacgcttgggggccggctgggaaaaactggcggaaaatattataactgnactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcggggcgcaggaggtgggctcagggttctccagagaatccccatgagctgacccgcagggcggccgggccagtaggcaccgggcccccgcggtgacctgcggacccgaagctggagcagccactgcaaatgctgcgctgaccccaaatgctgtgtcctttaaatgttttaattaagaataattaataggtccgggtgtggaggctcaagccttaatccccagcacctggcgaggccgaggaggga

SEQ ID NO: 39 - DNA, 2331 bp, Artificial Sequence
  sequence of STAR39
tcactgcaacctccacctcccaggttcaagtgattctcctgcctcggcctcccgagtagctgggactacaggtgcatgacaccgcacctggctagtttttgtatttttagtagagacagggtttcactatgttggccaggttggtctcgaactcctgaccttgtgatccgcccacctcggcctcccaaagtgctgggattacagagtgagccactgcgcctggcctgcaccccttactattatatgctttgcattttcttttagatttgaagaacctcattataaactctagcactaatcttatgtcagttaaatgcatagcaaatatctcctgacgtgggagaatatatatttgcaagtcttcttgtgaacatatgttttcagttctagggagccagacgcctatgagtgaaaagcctagtcatcgtggagaagtgcattcaactttgtaagaaactgccaaacctttattcataatggttgtataaattttacattaccaccaataatgtatgagagttccagttgcttcacatcctcaccagcattttgttttgtctgtcttttttcctttggttattctagtgggcataagatataatagtatcccttgtggtttaatgtaaattccactgaagactaataacatttgcatatttctaattaataagcctttttaagtgacttttcaagtctttgctcatttttattagatatttgccttcttattattgatttgaaagaattatatttatatgcttatattctggttataagccctttgtcattattttccaaaacaatatttggttgtttctgtactactttccttgctcctttgaattgacttggtgccttggccaaaaatcaattgaccacatacatgtgggtgcatctccagactaccacattccgtttatctatttgtctctccttgtgtcaataacactctgtcttgataatggtaagttttgagatcaggttgtgtaagtcctcctaatttttcctgggttttcaatattgctttgctttttaaaaattttgtattttcatttacattttaaaataaacttgttagtgggattttgattggcattgcactgaactcgtggatcaatttggggagattggacattcttatatatggatcccgtggtcatcaactttaagaactctttctcatccattagtaactcaatctaggttcagatgctactcgttttctgctcagtctgtgtctgagccccttatgctcttcattttgtcatccaattaacctcagctttgcatcaatactatttcttgctttggtgcctgttacctctcctctaatcaccaatccacaacttacctccaaattcagggcttgtctcattcttcccaggaggagtgctgctcagtctatctacttagtattataatttctctggcttggtatcaaggcactcccatttccggcttccatgagatgtctcagagggcatgctgcccggtgtagctgcatggtcaagcttcttcatatctcttgcctcatcacttaaactcactattttgtactcctgcttcagctatagggagctactgttagtttcttgaagacatatgctctctctctctctcacatctggacctgagcacatcctgttactgctgcttgaaacaatgtgatccccaggcacacaccattagcttagaagcctcccctgattcttcaaggctggttgagtcccttctctgtgctctcatgacaacagttggcaattcctcgttgcagcacctagcccatgatgctctttggaggcagagactgagtctttctcactattgaatttccagcattcatcacagagcctggcatatataaagccctccatcatatgtattaagtgaatggataaatgaaaaaaagttatatatatgtacatatatgtgtatatatgtatatgtatatatgtgtatatatgtgtgtatatgtgtgtgtatatatgtacatatatatgtatctatgtacatatatgtatatatgtatatatatgtgtgtgtatatgtgtgtgtgtatgtatatatattacaatgaaatactattcagccttaaaaaggcagggaatcctgtcatttaacacaatatggataaacctagaggactctaaaggcaaataccacatgttctcactcacaaaatctaaacaagttgaactcctacaagtagagagtaggatgatggttaccaagggctgggggacgggagaggatggggaaagcatagctgtccatcaaagggtagaaagtttcatttagacaagaggaatcagctttagtgatctatttcac

SEQ ID NO: 40 - DNA, 1071 bp, Artificial Sequence
  sequence of STAR40
gctgtgattcaaactgtcagcgagataaggcagcagatcaagaaagcactccgggctccagaaggagccttccaggccagctttgagcataagctgctgatgagcagtgagtgtcttgagtagtgttcagggcagcatgttaccattcatgcttgacttctagccagtgtgacgagaggctggagtcaggtctctagagagttgagcagctccagccttagatctcccagtcttatgcggtgtgcccattcgctttgtgtctgcagtcccctggccacacccagtaacagttctgggatctatgggagtagcttccttagtgagctttcccttcaaatactttgcaaccaggtagagaattttggagtgaaggttttgttcttcgtttcttcacaatatggatatgcatcttcttttgaaaatgttaaagtaaattacctctcttttcagatactgtcttcatgcgaacttggtatcctgtttccatcccagccttctataacccagtaacatcttttttgaaaccagtgggtgagaaagacacctggtcaggaacgcggaccacaggacaactcaggctcacccacggcatcagactaaaggcaaacaaggactctgtataaagtaccggtggcatgtgtattagtggagatgcagcctgtgctctgcagacagggagtcacacagacacttttctataatttcttaagtgctttgaatgttcaagtagaaagtctaacattaaatttgattgaacaattgtatattcatggaatattttggaacggaataccaaaaaatggcaatagtggttctttctggatggaagacaaacttttcttgtttaaaataaattttattttatatatttgaggttgaccacatgaccttaaggatacatatagacagtaaactggttactacagtgaagcaaattaacatatctaccatcgtacatagttacatttttttgtgtgacaggaacagctaaaatctacgtatttaacaaaaatcctaaagacaatacatttttattaactatagccctcatgatgtacattagatctctaa

SEQ ID NO: 41 - DNA, 1135 bp, Artificial Sequence
  sequence of STAR41
tgctcttgttgcccaggctgcagtgcaatggcgctgtctcggctcatcgcaacctccgcctcccagattcaagtgattctcctgcctcaccctcccaagtagctgggattaccagtatgcagcaacacgcccggctaattttgtatttgtaatagagacggggtttcttcatgttggtcaggctggtctcaaattcctgccctcaggtgatctgcccaccttggcctcccaaagtgctgggattacaggcatgagccactgtgcccggcctgggctggggcttttaaggggactggagggtgaggggctggaaaattgggagagttgattggtggggcaagggggatgtaatcatcagggtgtacaaactgcactcttggtttagtcagctcctcgtggggtccttcggagcagctcagtcagtagctccatcagtatacaggacccaaaggaatatctcaaagggaaaacagcatttcctaaggttcaagttgtgatctacggagcagttaggggaactacaatcttgtgacagggtctacatgcttctgaggcaatgagacaccaagcagctacgaggaagcagtcagagagcacgccgacctagtgactgatgctgatgtgctgcgagctgggttcattttcatttctcccctccccctgccctcattaattttgtaaagtttatagggaacatttcacccactctgctgtggatccctgtcacttacggagtctgtcatcttggctgtatgggctgtggcctctgcggtgcccattctcaggaggtgtgagacccatgaggaccggaggtggacaaggctagagaccacacccccccgctccatccaatcatgttttcctgggtgcttggtttctatgcaggctgcatgtccttagtccctgcatgggaacagctcctgtggtgagcaggcccctgaggaaggccttgagcgggaatggagcctaggcttaggctgcctggtaagagctggagggaaccagccgaggcttgtgctacttttttttccagaatgaaatacgtgactgatgttggtgtcctgcagcgccacgtttcccgccacaaccaccggaacgaggatgaggagaacacactctccgtggactgcacacg

SEQ ID NO: 42 - DNA, 735 bp, Artificial Sequence
  sequence of STAR42
aagggtgagatcactagggagggaggaaggagctataaaagaaagaggtcactcatcacatcttacacactttttaaaaccttggttttttaatgtccgtgttcctcattagcagtaagccctgtggaagcaggagtctttctcattgaccaccatgacaagaccctatttatgaaacataatagacacacaaatgtttatcggatatttattgaaatataggaatttttcccctcacacctcatgaccacattctggtacattgtatgaatgaatataccataattttacctatggctgtatatttaggtcttttcgtgcaggctataaaaatatgtatgggccggtcacagtgacttacgcccgtagtcccagaactttgggaggccgaggcgggtggatcacctgaggtcgggagttcaaaaccagcctgaccaacatggagaaaccccgtctctgctaaaaatacaaaaattaactggacacggtggcgtatgcctgtaatcccagctactcgggaagctgaggcaggagaactgcttgaacccaggaggcggaggttgtggtgagtcgagattgcgccattgcactccagcctgggcaacaagagcgaaattccatctcaaaaaaaagaaaaaagtatgactgtatttagagtagtatgtggatttgaaaaattaataagtgttgccaacttaccttagggtttataccatttatgagggtgtcggtttc

SEQ ID NO: 43 - DNA, 1227 bp, Artificial Sequence
  sequence of STAR43
caaatagatctacacaaaacaagataatgtctgcccatttttccaaagataatgtggtgaagtgggtagagagaaatgcatccattctccccacccaacctctgctaaattgtccatgtcacagtactgagaccagggggcttattcccagcgggcagaatgtgcaccaagcacctcttgtctcaatttgcagtctaggccctgctatttgatggtgtgaaggcttgcacctggcatggaaggtccgttttgtacttcttgctttagcagttcaaagagcagggagagctgcgagggcctctgcagcttcagatggatgtggtcagcttgttggaggcgccttctgtggtccattatctccagcccccctgcggtgttgctgtttgcttggcttgtctggctctccatgccttgttggctccaaaatgtcatcatgctgcaccccaggaagaatgtgcaggcccatctcttttatgtgctttgggctattttgattccccgttgggtatattccctaggtaagacccagaagacacaggaggtagttgctttgggagagtttggacctatgggtatgaggtaatagacacagtatcttctctttcatttggtgagactgttagctctggccgcggactgaattccacacagctcacttgggaaaactttattccaaaacatagtcacattgaacattgtggagaatgagggacagagaagaggccctagatttgtacatctgggtgttatgtctataaatagaatgctttggtggtcaactagacttgttcatgttgacatttagtcttgccttttcggtggtgatttaaaaattatgtatatcttgtttggaatatagtggagctatggtgtggcattttcatctggctttttgtttagctcagcccgtcctgttatgggcagccttgaagctcagtagctaatgaagaggtatcctcactccctccagagagcggtcccctcacggctcattgagagtttgtcagcaccttgaaatgagtttaaacttgtttatttttaaaacattcttggttatgaatgtgcctatattgaattactgaacaaccttatggttgtgaagaattgatttggtgctaaggtgtataaatttcaggaccagtgtctctgaagagttcatttagcatgaagtcagcctgtggcaggttgggtggagccagggaacaatggagaagctttcatgggtgg

SEQ ID NO: 44 - DNA, 1586 bp, Artificial Sequence
  sequence of STAR44
tgagttggggtcctaagccagaagttaactatgctttcatatattcttgcaagtagaagtacagtgttggtgtaaattccccttagatggatagctaagcccagaggaaataatggtaattggaaccatatgaccgtatgcaattcatgtgcatatttatatcaagaaaagaacattataggtcgggtgagaccctattttgttctgacaatgtcatctgtatttacatgtctgtttcgggagtttggatgtcaagggattctgtgctggattgtaaagcatgtgcttctgcttgatgtagctactcaattttgtattcttgactaataaagtcataaacataattcaacctctgtgtgcgtgctctccttccattaatttatactttagcaaaaagtattgaatgtgtgtgttatgtaacaatttcctataaattatattaaatgatttattagctttattcaataaagttttaagtgttttcttctatgactacattatttgttaacaagaaatttctttaactgaaaacttcaaggaagactatctgggtaactctttcaaaaagaattgtccctgtattttgggattgaatatattaatttcttgtactgttttaacagcacataattttacaagacaagccactttttcaaagcctgcttctcctcccattttccctatctctgtgattgacacctccaacccctgtagcctgcctctgctctctcttaaccagtcctactgatactacttcctaagtatttttcagccctgtccttcctctccatcatgatggattcacttccagttgaaatccttatggtaccctccctggattatggcagtaatcagagagctggtctccttaactcaggattcacttcttctcatctgttgttcacagtgacatcagaaagatattttaaaatgatgaactagaattaattatataaaacacacatacacacataaataatacttaaatttttcaatgatgttccaattatgtaaaatataatataggaggcactttatgttctggcctcaatctttcaattcaaacttatctcctgccactatctcctttgaacattgtattccagctactttagaataataataatacataatattcatagagcccttcctgggttcctatcaccgtacaaaatacttcacatataacatttaatctttgacaactttattaggcatgcacaattattatctatctatatatctatatctatatatataaaatctatattttatagataagaaaatagagggtaaaaacttgccaaaattacaaagcttagaagtgtagcagttgggatttgaatctaggcatcctgcctctatagtctacagtggctttcttgtgccaaaagccttgcagttccctagacttaacatttctcaaaatctgtgtctttcacatgctcttccaattgtctggaaaatctttcccaacctcagtctaactgtggtactcatgttcaccccacaagaattgactccatctgtcccctctccatgaaaatttctttgaatctcagcactttgggaggctgaggcaggtg

SEQ ID NO: 45 - DNA, 1981 bp, Artificial Sequence
  sequence of STAR45
cacgccccagcgtgccctggactactgctccgcaggactcctgttctgctgcaccctggactacggcaccagaggacccagctcccgccggcctgagctatggcaccagaggacccagctcccggcagcctggactatggcaccagaggacccagccccccgcttcctgggctaaggcacagtaggaccctgcctcatcgtgtactcctgctcaggaggaccctcgcagggcggcgcactggactaagctactgaaggagccccacccctgcctaaccctggactaaggcactggagaactcttgctccgcagagccacggactcttgcacaagagaacctcagcccagccgtgccctggactgtggcacagtagggcccacaccacgccatggactcctgtattggaggaagagtagtgataaatgtccaggtttacaacttgaaaagtagcaatcaatgtgccacaatagatggatgtgatgtaaaattataaatgatgaaaacattatgtgtaattgcctagccagaacagttacacaagacaaagacgtaaaagaaatccacatagggaaggaagaggtaagattgtttctgttttttgaaaatataatcttaagatagagaaaatcttaaagattccaccaaaataaatggttatagctgatgaagaaattcaataaagttaatagttacaaaatcaacatacaaatatcattattgtttctattaactaatgacaaactattacctgaaaaataaaggcaattcaatttataatagaatcaaaacagatatataaatatataaaagacaggagtaaatttaatcaaaaccataaaagatttacatactgaaaactatagcacattgatgaaaaaaattaaaatggcataaataaatggagaaacatccttcattgatggattcaaaaattagtattgtaaaagtgtcaatgctacccaaagcaatctacagattaaatgcaaccactatcaaattccaatgtcattcttcacagaaatagaaaaattactgctaaaatttgtatggaaccacaaaagacctggaccaaccaaagcaatcttgaacaaaaagaacaaagctggaggcatcagactacctgactccaaactctattacaaagctataggaattaaaacagcatagcaatggcataaaaacagacatgtaaaacagtacaaagggatatagaacctgtaaataaatccgtgtgtctgtggtcaattgattttttgataaaataactaaaaatacacagtgaagaaagaaaattattttcaataaatggtgtagacaaaactgactatccacatacagaagaataaaatttgacttttattttgctctttatacaagcatcaaatcaaaattaaagtttaaatgtaaaactactacaaggaaatatagaaggagactgtatgacattggcctgagctatgattttctgtagattattccaaaaggcaacaaaagcaaaacacacaaatgagactgcataaaacttaaaacttttccacaggaaaagaagcaatgatagaattaagagaacccacaaatgggataatatttttaaaccatacatcaggtaaggggctcatataataatatataagcaactcaacctactcaaaaataagaaaaaaactatgcttattaaaaaataagcaaagaatcagaatagacatttcctacatcatacaaaaggccaaccaggtacatgaaaaaatcataaacattcctaattatcagagaagtgcaaatcaatgccacaatgagatatcacctcacacattttactagggctattataaaaaaagatggaagataagtgttggtgaggatgtggagaaaaagaaaccctgtacactgttggtaggaatggaaattagtacagccatcttggaaaacagtacgaagctttctcaagaaattataaatttatttaccctatgatccat

SEQ ID NO: 46 - DNA, 1859 bp, Artificial Sequence
  sequence of STAR46
attgtttttctcgcccttctgcattttctgcaaattctgttgaatcattgcagttacttaggtttgcttcgtctcccccattacaaactacttactgggtttttcaaccctagttccctcatttttatgatttatgctcatttctttgtacacttcgtcttgctccatctcccaactcatggcccctggctttggattattgttttggtcttttattttttgtcttcttctacctcaacacttatcttcctctcccagtctccggtaccctatcaccaaggttgtcattaacctttcatattattcctcattatccatgtattcatttgcaaataagcgtatattaacaaaatcacaggtttatggagatataattcacataccttaaaattcaggcttttaaagtgtacctttcatgtggtttttggtatattcacaaagttatgcattgatcaccaccatctgattccataacatgttcaatacctcaaaaagaagtctgtactcattagtagtcatttcacattcaccactccctctggctctgggcagtcactgatctttgtgtctctatggatttgcctagtctaggtatttttatgtaaatggcatcatacaacatgtgaccttttgtttggcttttttcatttagcaaaatgttatcaaggtctgtccctgttgtagcatgtattagcacttcatttcttatatgctgaatgatatactttatttgtccatcagttgttcatgctttatttgtccatcagttgatgaacatttgcgtttttgccactttgggctattaagaataatgctactgtgaacaagtgtgtacaagttcctctacaaatttttgtgtggacatatcctttcagttctctcaggtgtatatctgggaattgaattgctgggtcgtgtagtagctatgttaaacactttgagaaactgctataatgttctccagagctgtaccattttaaattctgtgtatgaggattccacgttctccacttcctcaccagtgtatggatttgggggtatactttttaaaaagtgggattaggctgggcacagtggctcacacctgtaatcccaacacttcaggaagctgaggtgggaggatcacttgagcctagtagtttgagaccagcctgggcaacatagggagaccctgtctctacaaaaaataatttaaaataaattagctgggcgttgtggcacacacctgtagtcccagctacatgggaggctgaggtggaaggattccctgagcccagaagtttgaggttgcagtgagccatgatggcagcactatactgtagcctgggtgtcagagcaagactccgtttcagggaagaaaaaaaaaagtgggatgatatttttgacacttttcttcttgttttcttaatttcatacttctggaaattccattaaattagctggtaccactctaactcattgtgtttcatggctgcatagtaatattgcataatataaatataccattcattcatcaaagttagcagatattgactgttaggtgccaggcactgctctaagcgttaaagaaaaacacacaaaaacttttgcattcttagagtttattttccaatggagggggtggagggaggtaagaatttaggaaataaattaattacatatatagcatagggtttcaccagtgagtgcagcttgaatcgttggcagctttcttagtagtataaatacagtactaaagatgaaattactctaaatggtgttacttaaattactggaataggtattactattagtcactttgcaggtgaaagtggaaacaccatcgtaaaatgtaaaataggaaacagctggttaatgtt

SEQ ID NO: 47 - DNA, 1082 bp, Artificial Sequence
  sequence of STAR47
atcattagtcattagggaaatgcaaatgaaaaacacaagcagccaccaatatacacctactaggatgatttaaaggaaaataagtgtgaagaaggacgtaaagaaattgtaaccctgatacattgatggtagaaatggataaagttgcagccactgtgaaaaacagtctgcagtggctcagaaggttaaatatagaacccctgttggacccaggaactctactcttaggcaccccaaagaatagagaacagaaatcaaacagatgtttgtatactaatgtttgtagcatcacttttcacaggagccaaaaggtggaaataatccaaccatcagtgaacaaatgaatgtaataaaagcaaggtggtctgcatgcaatgctacatcatccatctgtaaaaaacgaacatcattttgatagatgatacaacatgggtggacattgagaacattatgcttagtgaaataagccagacacaaaaggaatatattgtataattgtaattacatgaagtgcctagaatagtcaaattcatacaagagaaagtgggataggaatcaccatgggctggaaatagggggaaggtgctatactgcttattgtggacaaggtttcgtaagaaatcatcaaaattgtgggtgtagatagtggtgttggttatgcaaccctgtgaatatattgaatgccatggagtgcacactttggttaaaaggttcaaatgataaatattgtgttatatatatttccccacgatagaaaacacgcacagccaagcccacatgccagtcttgttagctgccttcctttaccttcaagagtgggctgaagcttgtccaatctttcaaggttgctgaagactgtatgatggaagtcatctgcattgggaaagaaattaatggagagaggagaaaacttgagaatccacactactcaccctgcagggccaagaactctgtctcccatgctttgctgtcctgtctcagtatttcctgtgaccacctcctttttcaactgaagactttgtacctgaaggggttcccaggtttttcacctcggcccttgtcaggactgatcctctcaacta

SEQ ID NO: 48 - DNA, 1242 bp, Artificial Sequence
  sequence of STAR48
atcatgtatttgttttctgaattaattcttagatacattaatgttttatgttaccatgaatgtgatattataatataatatttttaattggttgctactgtttataagaatttcattttctgtttactttgccttcatatctgaaaaccttgctgatttgattagtgcatccacaaattttcttggattttctatgggtaattacaaatctccacacaatgaggttgcagtgagccaagatcacaccactgtactccagcctgggcgacagagtgagacaccatctcacaaaaacacataaacaaacaaacagaaactccacacaatgacaacgtatgtgctttctttttttcttcctctttctataatatttctttgtcctatcttaactgaactggccagaaaccccaggacaatgataaatacgagcagtgtcaacagacatctcattccctttcctagcttttataaaaataacgattatgcttcaacattacatatggtggtgtcgatggttttgttatagataagcttatcaggttaagaaatttgtctgcgtttcctagtttggtataaagattttaatataaatgaatgttgtattttatcatcttatttttttcctacatctgctaaggtaatcctgtgttttccccttttcaatctcctaatgtggtgaatgacattaaaataccttctattgttaaaatattcttgcaacgctgtatagaaccaatgcctttattctgtattgctgatggatttttgaaaaatatgtaggtggacttagttttctaaggggaatagaatttctaatatatttaaaatattttgcatgtatgttctgaaggacattggtgtgtcatttctataccatctggctactagaggagccgactgaaagtcacactgccggaggaggggagaggtgctcttccgtttctggtgtctgtagccatctccagtggtagctgcagtgataataatgctgcagtgccgacagttctggaaggagcaacaacagtgatttcagcagcagcagtattgcgggatccccacgatggagcaagggaaataattctggaagcaatgacaatatcagctgtggctatagcagctgagatgtgagttctcacggtggcagcttcaaggacagtagtgatggtccaatggcgcccagacctagaaatgcacatttcctcagcaccggctccagatgctgagcttggacagctgacgcct

SEQ ID NO: 49 - DNA, 1015 bp, Artificial Sequence
  sequence of STAR49
aaaccagaaacccaaaacaatgggagtgacatgctaaaaccagaaacccaaaacaatgggagggtcctgctaaaccagaaacccaaaacaatgggagtgaagtgctaaaaccagaaacccaaaacaatgggagtgtcctgctacaccagaaacccaaaacgatgggagtgacgtgataaaaccagacacccaaaacaatgggagtgacgtgctaaaccagaaacccaaaacaatgggagtgacgtgctaaaacctggaaacctaaaacaatgcgagtgaggtgctaacaccagaatccataacaatgtgagtgacgtgctaaaccagaacccaaaacaatgggagtgacgtgctaaaacaggaacccaaaacaatgagagtgacgtgctaaaccagaaacccaaaacaatgggaatgacgtgctaaaaccggaacccaaaacaatgggagtgatgtgctaaaccagaaacccaaaacaatgggaatgacatgctaaaactggaacccaaaacaatggtaactaagagtgatgctaaggccctacattttggtcacactctcaactaagtgagaacttgactgaaaaggaggatttttttttctaagacagagttttggtctgtcccccagagtggagtgcagtggcatgatctcggctcactgcaagctctgcctcccgggttcaggccattctcctgcctcagcctcctgagtagctgggaatacaggcacccgccaccacacttggctaattttttgtatttttagtagagatggggtttcaccatattagcaaggatggtctcaatctcctgacctcgtgatctgcccacctcaggctcccaaagtgctgggattacaggtgtgagccaccacacccagcaaaaaggaggaatttttaaagcaaaattatgggaggccattgttttgaactaagctcatgcaataggtcccaacagaccaaaccaaaccaaaccaaaatggagtcactcatgctaaatgtagcataatcaaa

SEQ ID NO: 50 - DNA, 2355 bp, Artificial Sequence
  sequence of STAR50
caaccatcgttccgcaagagcggcttgtttattaaacatgaaatgagggaaaagcctagtagctccattggattgggaagaatggcaaagagagacaggcgtcattttctagaaagcaatcttcacacctgttggtcctcacccattgaatgtcctcacccaatctccaacacagaaatgagtgactgtgtgtgcacatgcgtgtgcatgtgtgaaagtatgagtgtgaatgtgtctatatgggaacatatatgtgattgtatgtgtgtaactatgtgtgactggcagcgtggggagtgctggttggagtgtggtgtgatgtgagtatgcatgagtggctgtgtgtatgactgtggcgggaggcggaaggggagaagcagcaggctcaggtgtcgccagagaggctgggaggaaactataaacctgggcaatttcctcctcatcagcgagcctttcttgggcaataggggcagagctcaaagttcacagagatagtgcctgggaggcatgaggcaaggcggaagtactgcgaggaggggcagagggtctgacacttgaggggttctaatgggaaaggaaagacccacactgaattccacttagccccagaccctgggcccagcggtgccggcttccaaccataccaaccatttccaagtgttgccggcagaagttaacctctcttagcctcagtttccccacctgtaaaatggcagaagtaaccaagcttaccttcccggcagtgtgtgaggatgaaaagagctatgtacgtgatgcacttagaagaaggtctagggtgtgagtggtactcgtctggtgggtgtggagaagacattctaggcaatgaggactggggagagcctggcccatggcttccactcagcaaggtcagtctcttgtcctctgcactcccagccttccagagaggaccttcccaaccagcactccccacgctgccagtcacacatagttacacacatacaatcacatatatgttcccatatagacacattcacactcataccttcacacatgcacacgcatgtgcacacacagtcactcatttctgtgttggagattgggtgaggacattcaatgggtgaggaccaacaggtgtgaagattgctttctagaaaatgactcctgtctctctttgccattcttcccaatccgatggagctactaggcttttccctcatttcatgtttaataaaccttcccaatggcgaaatgggctttctcaagaagtggtgagtgtcccatccctgcggtggggacaggggtggcagcggacaagcctgcctggagggaactgtcaggctgattcccagtccaactccagcttccaacacctcatcctccaggcagtcttcattcttggctctaatttcgctcttgttttcttttttatttttatcgagaactgggtggagagcttttggtgtcattggggattgctttgaaacccttctctgcctcacactgggagctggcttgagtcaactggtctccatggaatttctttttttagtgtgtaaacagctaagttttaggcagctgttgtgccgtccagggtggaaagcagcctgttgatgtggaactgcttggctcagatttcttgggcaaacagatgccgtgtctctcaactcaccaattaagaagcccagaaaatgtggcttggagaccacatgtctggttatgtctagtaattcagatggcttcacctgggaagccctttctgaatgtcaaagccatgagataaaggacatatatatagtagctagggtggtccacttcttaggggccatctccggaggtggtgagcactaagtgccaggaagagaggaaactctgttttggagccaaagcataaaaaaaccttagccacaaaccactgaacatttgttttgtgcaggttctgagtccagggagggcttctgaggagaggggcagctggagctggtaggagttatgtgagatggagcaagggccctttaagaggtgggagcagcatgagcaaaggcagagaggtggtaatgtataaggtatgtcatgggaaagagtttggctggaacagagtttacagaatagaaaaattcaacactattaattgagcctctactacgtgctcgacattgttctagtcactgagataggtttggtatacaaaacaaaatccatcctctatggacattttagtgactaacaacaatataaataataaaagtgaacaaaagctcaaaacatgccaggcactattatttatttatttatttatttatttatttattttttgaaacagagtctcgctctgttgcccaggctggagtgtagtggtgcgatctcggctcactg

SEQ ID NO: 51 - DNA, 2289 bp, Artificial Sequence
  sequence of STAR51
tcacaggtgacaccaatcccctgaccacgctttgagaagcactgtactagattgactttctaatgtcagtcttcattttctagctctgttacagccatggtctccatattatctagtacaacacacatacaaatatgtgtgatacagtatgaatataatataaaaatatgtgttataatataaatataatattaaaatatgtctttatactagataataatacttaataacgttgagtgtttaactgctctaagcactttacctgcaggaaacagttttttttttattttggtgaaatacaactaacataaatttatttacaattttaagcatttttaagtgtatagtttagtggagttaatatattcaaaatgttgtgcagccgtcaccatcatcagtcttcataactcttttcatattgtaaaattaaaagtttatgctcatttaaaaatgactcccaatttcccccctcctcaacctctggaaactaccattctattttctgcctccgtagttttgcccactctaagtacctcacataagtggaatttgtcttatttgcctgtttgtgaccggctgatttcatttagtataatgtcctcaagttttattcacgttatatagcatatgtcataattttcttcacttttaagcttgagtaatatttcatcgtatgtatctcacattttgcttatccattcatctctcagtggacacttgagttgcttctacattttagctgttgtgaatactgctgctatgaacatgggtgtataaatatctcaagacctttttatcagttttttaaaatatatactcagtagtagtttagctggattatatggtaattttatttttaatttttgaggaactgtcctacccttttattcaatagtagctataccaattgacaattggcattcctaccaacagggcataagggttctcaattctccacatattccctgatacttgttattttcaggtgttttttttttttttttttttttatgggagccatgttaatgggtgtaaggtgatatttcattatagttttgatttgcatttccctaatgattagtgatgttaagcatctcttcatgtgcctattggccatttgtatatcttctttaaaaatatatatatactcattcctttgcccatttttgaattatgtttattttttgttattgagtttcaatacttttctatataacctaggtattaatcctttatcagacttaagatttgcaaatattctctttcattccacaggttgctaattctctctgttggtaatatcttttgatgctgttgtgtccagaattgattcattcctgtgggttcttggtctcactgacttcaagaataaagctgcggaccctagtggtgagtgttacacttcttatagatggtgtttccggagtttgttccttcagatgtgtccagagtttcttccttccaatgggttcatggtcttgctgacttcaggaatgaagccgcagaccttcgcagtgaggtttacagctcttaaaggtggcgtgtccagagttgtttgttccccctggtgggttcgtggtcttgctgacttcaggaatgaagccgcagaccctcgcagtgagtgttacagctcataaaggtagtgcggacacagagtgagctgcagcaagatttactgtgaagagcaaaagaacaaagcttccacagcatagaaggacaccccagcgggttcctgctgctggctcaggtggccagttattattcccttatttgccctgcccacatcctgctgattggtccattttacagagtactgattggtccattttacagagtgctgattggtgcatttacaatcctttagctagacacagagtgctgattgctgcattcttacagagtgctgattggtgcatttacagtcctttagctagatacagaacgctgattgctgcgttttttacagagtgctgattggtgcatttacaatcctttagctagacacagtgctgattggtgggtttttacagagtgctgattggtgcgtctttacagagtgctgattggtgcatttacaatcctttagctagacacagagtgctgattggtgcgtttataatcctctagctagacagaaaagttttccaagtccccacctgaccgagaagccccactggcttcacctctcactgttatactttggacatttgtccccccaaaatctcatgttgaaatgtaacccctaatgttggaactgaggccagactggatgtggctgggccatgggga

SEQ ID NO: 52 - DNA, 1184 bp, Artificial Sequence
  sequence of STAR52
cttatgccatctggcggtgccatgtggaacttcgctgaagaagctaaatttactgaccatctgtgcctagagcgggtttctccaaggaaaggctctgtaaatctcgtccttttgaaatctaggggaaaacagcctccttcactgaggattaatttaaagaaagggggaaataggaaaattccatgcgttggaagtccatttagatttctacatgaaccatcatatatgtgcactacataattcttatttttttatttttaaaaaagggataatttatattccagtgacaagtttgggaaaggccaaggcaagcaattgagttgaacattatgtagcgtttatatagaccttgcagacgtctgtgcaatatccaccactgaacacgtgaggtcgtactcaagtctctctggcccctggtaatgtgactcccttcctttatttgcatgaatcgcctggattgggtgtcaggtttttaaaacgtcaaggtttacgcctattgttgtcaaccaatcagcatcctactttgacgtgattggcttctactgtaggtgtcaatcatccaaaatttgcatactactcctcaggccgccgggagcctgtcagtcggctgtggcagctggaagagaaggaatcggacggagaagaatgaaaaatcactttgctttcgcaaagcgaaagaaaagtattcttttcctcattatttttaaataaatttgattgtatatttacctaataaaataaacattcaattaaacaaaaataagcaactatcaaagatttgtttactaattttcgtaatgtttactgtttcaataagtagccaaaggaatattaaaacacaaaaatatgaatgctgataattttatgtcataaagaccattttaaaactaaaagtgaacatggggtttctaaataaaattaccgtggtagcgtaaaaacactgctttcaatacttgggcatgctgaaagtgctgcatcctaagataaaaaatacaccaagggggggatttcaaagaacattattttgcttttaataatcctgtatttctgtcactttgccctttttatttatttaccgtgaactcacagacagaatattacttggagtttctgaaatacttgtgtttgtacatttctcatcttacacgtacccacacaccccaaaataaaaaaacaaagaagag

SEQ ID NO: 53 - DNA, 1431 bp, Artificial Sequence
  sequence of STAR53
ccctgaggaagatgacgagtaactccgtaagagaaccttccactcatcccccacatccctgcagacgtgctattctgttatgatactggtatcccatctgtcacttgctccccaaatcattcccttcttacaattttctactgtacagcattgaggctgaacgatgagagatttcccatgctctttctactccctgccctgtatatatccggggatcctccctacccaggatgctgtggggtcccaaaccccaagtaagccctgatatgcgggccacacctttctctagcctaggaattgataacccaggcgaggaagtcactgtggcatgaacagatggttcacttcgaggaaccgtggaaggcgtgtgcaggtcctgagatagggcagaatcggagtgtgcagggtctgcaggtcaggaggagttgagattgcgttgccacgtggtgggaactcactgccacttatttccttctctcttcttgcctcagcctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttccccagttgtttgctcgtgccattattgtgcacacagctctgtgcacgtgtgtgcatatttctttaggaaagattcttagaagtggaattgctgtgtcaaaggagtcatttattcaacaaaacactaatgagtgcgtcctcgtgctgagcgctgttctaggtgctggagcgacgtcagggaacaaggcagacaggagttcctgacccccgttctagaggaggatgtttccagttgttgggttttgtttgtttgtttcttctagagatggtggtcttgctctgtccaggctagagtgcagtggcatgatcatagc

SEQ ID NO: 54 - DNA, 975 bp, Artificial Sequence
  sequence of STAR54
ccataaaagtgtttctaaactgcagaaaaatccccctacagtcttacagttcaagaattttcagcatgaaatgcctggtagattacctgactttttttgccaaaaataaggcacagcagctctctcctgactctgactttctatagtccttactgaattatagtccttactgaattcattcttcagtgttgcagtctgaaggacacccacattttctctttgtctttgtcaattctttgtgttgtaagggcaggatgtttaaaagttgaagtcattgacttgcaaaatgagaaatttcagagggcattttgttctctagaccatgtagcttagagcagtgttcacactgaggttgctgctaatgtttctgcagttcttaccaatagtatcatttacccagcaacaggatatgatagaggacttcgaaaaccccagaaaatgttttgccatatatccaaagccctttgggaaatggaaaggaattgcgggctcccatttttatatatggatagatagagaccaagaaagaccaaggcaactccatgtgctttacattaataaagtacaaaatgttaacatgtaggaagtctaggcgaagtttatgtgagaattctttacactaattttgcaacattttaatgcaagtctgaaattatgtcaaaataagtaaaaatttttacaagttaagcagagaataacaatgattagtcagagaaataagtagcaaaatcttcttctcagtattgacttggttgcttttcaatctctgaggacacagcagtcttcgcttccaaatccacaagtcacatcagtgaggagactcagctgagactttggctaatgttggggggtccctcctgtgtctccccaggcgcagtgagcctgcaggccgacctcactcgtggcacacaactaaatctggggagaagcaacccgatgccagcatgatgcagatatctcagggtatgatcggcc

SEQ ID NO: 55 - DNA, 501 bp, Artificial Sequence
  sequence of STAR55
cctgaactcatgatccgcccacctcagcctcctgaagtgctgggattacaggtgtgagccaccacacccagccgcaacacactcttgagcaaccaatgtgtcataaaagaaataaaatggaaatcagaaagtatcttgagacagacaaaaatggaaacacaacataccaaaatttatgggacacagcaaaagcagttttaggagggaagtttatagtgatgaatacctacctcaaaatcattagcctgattggatgacactacagtgtataaatgaattgaaaaccacattgtgccccatacatatatacaatttttatttgttaattaaaaataaaataaaactttaaaaaagaagaaagagctcaaataaacaacctaactttatacctcaaggaaatagaagagccagctaagcccaaagttgacagaaggaaaaaaatattggcagaaagaaatgaaacagagactagaaagacaattgaagagatcagcaaaacta

SEQ ID NO: 56 - DNA, 741 bp, Artificial Sequence
  sequence of STAR56
acacaggaaaagatcgcaattgttcagcagagctttgaaccggggatgacggtctccctcgttgcccggcaacatggtgtagcagccagccagttatttctctggcgtaagcaataccaggaaggaagtcttactgctgtcgccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgccaacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtg

SEQ ID NO: 57 - DNA, 1365 bp, Artificial Sequence
  sequence of STAR57
tccttctgtaaataggcaaaatgtattttagtttccaccacacatgttcttttctgtagggcttgtatgttggaaattttatccaattattcaattaacactataccaacaatctgctaattctggagatgtggcagtgaataaaaaagttatagtttctgattttgtggagcttggactttaatgatggacaaaacaacacattcttaaatatatatttcatcaaaattatagtgggtgaattatttatatgtgcatttacatgtgtatgtatacataaatgggcggttactggctgcactgagaatgtacacgtggcgcgaacgaggctgggcggtcagagaaggcctcccaaggaggtggctttgaagctgagtggtgcttccacgtgaaaaggctggaaagggcattccaagaaaaggctgaggccagcgggaaagaggttccagtgcgctctgggaacggaaagcgcacctgcctgaaacgaaaatgagtgtgctgaaataggacgctagaaagggaggcagaggctggcaaaagcgaccgaggaggagctcaaaggagcgagcggggaaggccgctgtggagcctggaggaagcacttcggaagcgcttctgagcgggtaaggccgctgggagcatgaactgctgagcaggtgtgtccagaattcgtgggttcttggtctcactgacttcaagaatgaagagggaccgcggaccctcgcggtgagtgttacagctcttaaggtggcgcgtctggagtttgttccttctgatgttcggatgtgttcagagtttcttccttctggtgggttcgtggtctcgctggctcaggagtgaagctgcagaccttcgcggtgagtgttacagctcataaaagcagggtggactcaaagagtgagcagcagcaagatttattgcaaagaatgaaagaacaaagcttccacactgtggaaggggaccccagcgggttgccactgctggctccgcagcctgcttttattctcttatctggccccacccacatcctgctgattggtagagccgaatggtctgttttgacggcgctgattggtgcgtttacaatccctgcgctagatacaaaggttctccacgtccccaccagattagctagatagagtctccacacaaaggttctccaaggccccaccagagtagctagatacagagtgttgattggtgcattcacaaaccctgagctagacacagggtgatgactggtgtgtttacaaaccttgcggtagatacagagtatcaattggcgtatttacaatcactgagctaggcataaaggttctccaggtccccaccagactcaggagcccagctggcttcacccagtgg

SEQ ID NO: 58 - DNA, 1401 bp, Artificial Sequence
  sequence of STAR58
aagtttaccttagccctaaattatttcattgtgattggcattttaggaaatatgtattaaggaatgtctcttaggagataaggataacatatgtctaagaaaattatattgaaatattattacatgaactaaaatgttagaactgaaaaaaaattattgtaactccttccagcgtaggcaggagtatctagataccaactttaacaactcaactttaacaacttcgaaccaaccagatggctaggagattcacctatttagcatgatatcttttattgataaaaaaatataaaacttccattaaatttttaagctactacaatcctattaaattttaacttaccagtgttctcaatgctacataatttaaaatcattgaaatcttctgattttaactcctcagtcttgaaatctacttatttttagttacatatatatccaatctactgccgctagtagaagaagcttggaatttgagaaaaaaatcagacgttttgtatattctcatattcactaatttattttttaaatgagtttctgcaatgcatcaagcagtggcaaaacaggagaaaaattaaaattggttgaaaagatatgtgtgccaaacaatcccttgaaatttgatgaagtgactaatcctgagttattgtttcaaatgtgtacctgtttatacaagggtatcacctttgaaatctcaacattaaatgaaattttataagcaatttgttgtaacatgattattataaaattctgatataacattttttattacctgtttagagtttaaagagagaaaaggagttaagaataattacattttcattagcattgtccgggtgcaaaaacttctaacactatcttcaaatctttttctccattgccttctgaacatacccacttgggtatctcattagcactgcaaattcaacattttcgattgctaatttttctccctaaatatttatttgttttctcagctttagccaatgtttcactattgaccatttgctcaagtatagtgacgcttcaatgaccttcagagagctgtttcagtccttcctggactacttgcatgcttccaacaaaatgaagcactcttgatgtcagtcactcaaataaatggaaatgggcccatttactaggaatgttaacagaataaaaagatagacgtgacaccagttgcttcagtccatctccatttacttgcttaaggcctggccatatttctcacagttgatatggcgcagggcacatgtttaaatggctgttcttgtaggatggtttgactgttggattcctcatcttccctctccttaggaaggaaggttacagtagtactgttggctcctggaatatagattcataaagaactaatggagtatcatctcccactgctcttgt

SEQ ID NO: 59 - DNA, 866 bp, Artificial Sequence
  sequence of STAR59
gagatcacgccactgcactccagcctgggggacagagcaagactccatctcagaaacaaacaaacacacaaagccagtcaaggtgtttaattcgacggtgtcaggctcaggtctcttgacaggatacatccagcacccgggggaaacgtcgatgggtggggtggaatctattttgtggcctcaagggagggtttgagaggtagtcccgcaagcggtgatggcctaaggaagcccctccgcccaagaagcgatattcatttctagcctgtagccacccaagagggagaatcgggctcgccacagaccccacaacccccaacccaccccacccccacccctcccacctcgtgaaatgggctctcgctccgtcaggctctagtcacaccgtgtggttttggaacctccagcgtgtgtgcgtgggttgcgtggtggggtggggccggctgtggacagaggaggggataaagcggcggtgtcccgcgggtgcccgggacgtggggcgtggggcgtgggtggggtggccagagccttgggaactcgtcgcctgtcgggacgtctcccctcctggtcccctctctgacctacgctccacatcttcgccgttcagtggggaccttgtgggtggaagtcaccatccctttggactttagccgacgaaggccgggctcccaagagtctccccggaggcggggccttgggcaggctcacaaggatgctgacggtgacggttggtgacggtgatgtacttcggaggcctcgggccaatgcagaggtatccatttgacctcggtgggacaggtcagctttgcggagtcccgtgcgtccttccagagactcatccagcgctagcaagcatggtcccgagg

SEQ ID NO: 60 - DNA, 2067 bp, Artificial Sequence
  sequence of STAR60
  misc_feature (92)..(92): the 'n' at position 92 may be any nucleic acid
  misc_feature (293)..(293): the 'n' at position 293 may be any nucleic acid
  misc_feature (344)..(345): the 'n' at positions 345-345 may be any nucleic acid
  misc_feature (411)..(411): the 'n' at position 411 may be any nucleic acid
  misc_feature (460)..(460): the 'n' at position 460 may be any nucleic acid
  misc_feature (465)..(465): the 'n' at position 465 may be any nucleic acid
  misc_feature (902)..(902): the 'n' at position 902 may be any nucleic acid
  misc_feature (906)..(906): the 'n' at position 906 may be any nucleic acid
  misc_feature (924)..(924): the 'n' at position 924 may be any nucleic acid
  misc_feature (1522)..(1522): the 'n' at position 1522 may be any nucleic acid
  misc_feature (1590)..(1590): the 'n' at position 1590 may be any nucleic acid
  misc_feature (1601)..(1601): the 'n' at position 1601 may be any nucleic acid
  misc_feature (1647)..(1647): the 'n' at position 1647 may be any nucleic acid
  misc_feature (1677)..(1677): the 'n' at position 1677 may be any nucleic acid
  misc_feature (1777)..(1777): the 'n' at position 1777 may be any nucleic acid
agcagtgcagaactggggaagaagaagagtccctacaccacttaatactcaaaagtactcgcaaaaaataacacccctcaccaggtggcatnattactctccttcattgagaaaattaggaaactggacttcgtagaagctaattgctttatccagagccacctgcatacaaacctgcagcgccacctgcatacaaacctgtcagccgaccccaaagccctcagtcgcaccaagcctctgctgcacaccctcgtgccttcacactggccgttccccaagcctggggcatactncccagctctgagaaatgtattcatccttcaaagccctgctcatgtgtcctnntcaacaggaaaatctcccatgagatgctctgctatccccatctctcctgccccatagcttaggcanacttctgtggtggtgagtcctgggctgtgctgtgatgtgttcgcctgcnatgtntgttcttccccacaatgatgggcccctgaattctctatctctagcacctgtgctcagtaaaggcttgggaaaccaggctcaaagcctggcccagatgccaccttttccagggtgcttccgggggccaccaaccagagtgcagccttctcctccaccaggaactcttgcagccccacccctgagcacctgcaccccattacccatctttgtttctccgtgtgatcgtattattacagaattatatactgtattcttaatacagtatataattgtataattattcttaatacagtatataattatacaaatacaaaatatgtgttaatggaccgtttatgttactggtaaagctttaagtcaacagtgggacattagttaggtttttggcgaagtcaaaagttatatgtgcattttcaacttcttgaggggtcggtacntctnacccccatgttgttcaanggtcaactgtctacacatatcatagctaattcactacagaaatgttagcttgtgtcactagtatctccccttctcataagcttaatacacataccttgagagagctcttggccatctctactaatgactgaagtttttatttattatagatgtcataataggcataaaactacattacatcattcgagtgccaattttgccaccttgaccctcttttgcaaaacaccaacgtcagtacacatatgaagaggaaactgcccgagaactgaagttcctgagaccaggagctgcaggcgttagatagaatatggtgacgagagttacgaggatgacgagagtaaatacttcatactcagtacgtgccaagcactgctataagcgctctgtatgtgtgaagtcatttaatcctcacagcatcccacggtgtaattattttcattatccccatgagggaacagaaactcagaacggttcaacacatatgcgagaagtcgcagccggtcagtgagagagcaggttcccgtccaagcagtcagaccccgagtgcacactctcgacccctgtccagcagactcactcgtcataaggcggggagtgntctgtttcagccagatgctttatgcatctcagagtacccaaaccatgaaagaatgaggcagtattcangagcagatggngctgggcagtaaggctgggcttcagaatagctggaaagctcaagtnatgggacctgcaagaaaaatccattgtttngataaatagccaaagtccctaggctgtaaggggaaggtgtgccaggtgcaagtggagctctaatgtaaaatcgcacctgagtctcctggtcttatgagtnctgggtgtaccccagtgaaaggtcctgctgccaccaagtgggccatggttcagctgtgtaagtgctgagcggcagccggaccgcttcctctaacttcacctccaaaggcacagtgcacctggttcctccagcactcagctgcgaggcccctagccagggtcccggcccccggcccccggcagctgctccagcttccttccccacagcattcaggatggtctgcgttcatgtagacctttgttttcagtctgtgctccgaggtcactggcagcactagccccggctcctgt

SEQ ID NO: 61 - DNA, 1470 bp, Artificial Sequence
  sequence of STAR61
  misc_feature (130)..(130): the 'n' at position 130 may be any nucleic acid
  misc_feature (196)..(196): the 'n' at position 196 may be any nucleic acid
  misc_feature (205)..(205): the 'n' at position 205 may be any nucleic acid
  misc_feature (220)..(220): the 'n' at position 220 may be any nucleic acid
  misc_feature (262)..(262): the 'n' at position 262 may be any nucleic acid
  misc_feature (332)..(332): the 'n' at position 332 may be any nucleic acid
  misc_feature (856)..(856): the 'n' at position 856 may be any nucleic acid
  misc_feature (963)..(963): the 'n' at position 963 may be any nucleic acid
  misc_feature (976)..(976): the 'n' at position 963 may be any nucleic acid
cagcccccacatgcccagccctgtgctcagctctgcagcggggcatggtgggcagagacacagaggccaaggccctgcttcggggacggtgggcctgggatgagcatggccttggccttcgccgagagtnctcttgtgaaggaggggtcaggaggggctgctgcagctggggaggagggcgatggcactgtggcangaagtgaantagtgtgggtgcctngcaccccaggcacggccagcctggggtatggacccggggccntctgttctagagcaggaaggtatggtgaggacctcaaaaggacagccactggagagctccaggcagaggnacttgagaggccctggggccatcctgtctcttttctgggtctgtgtgctctgggcctgggcccttcctctgctcccccgggcttggagagggctggccttgcctcgtgcaaaggaccactctagactggtaccaagtctggcccatggcctcctgtgggtgcaggcctgtgcgggtgacctgagagccagggctggcaggtcagagtcaggagagggatggcagtggatgccctgtgcaggatctgcctaatcatggtgaggctggaggaatccaaagtgggcatgcactctgcactcatttctttattcatgtgtgcccatcccaacaagcagggagcctggccaggagggcccctgggagaaggcactgatgggctgtgttccatttaggaaggatggacggttgtgagacgggtaagtcagaacgggctgcccacctcggccgagagggccccgtggtgggttggcaccatctgggcctggagagctgctcaggaggctctctagggctgggtgaccaggnctggggtacagtagccatgggagcaggtgcttacctggggctgtccctgagcaggggctgcattgggtgctctgtgagcacacacttctctattcacctgagtcccnctgagtgatgagnacacccttgttttgcagatgaatctgagcatggagatgttaagtggcttgcctgagccacacagcagatggatggtgtagctgggacctgagggcaggcagtcccagcccgaggacttcccaaggttgtggcaaactctgacagcatgaccccagggaacacccatctcagctctggtcagacactgcggagttgtgttgtaacccacacagctggagacagccaccctagccccacccttatcctctcccaaaggaacctgccctttcccttcattttcctcttactgcattgagggaccacacagtgtggcagaaggaacatgggttcaggacccagatggacttgcttcacagtgcagccctcctgtcctcttgcagagtgcgtcttccactgtgaagttgggacagtcacaccaactcaatactgctgggcccgtcacacggtgggcaggcaacggatggcagtcactggctgtgggtctgcagaggtgg

SEQ ID NO: 62 - DNA, 1011 bp, Artificial Sequence
  sequence of STAR62
agtgtcaaatagatctacacaaaacaagataatgtctgcccatttttccaaagataatgtggtgaagtgggtagagagaaatgcatccattctccccacccaacctctgctaaattgtccatgtcacagtactgagaccagggggcttattcccagcgggcagaatgtgcaccaagcacctcttgtctcaatttgcagtctaggccctgctatttgatggtgtgaaggcttgcacctggcatggaaggtccgttttgtacttcttgctttagcagttcaaagagcagggagagctgcgagggcctctgcagcttcagatggatgtggtcagcttgttggaggcgccttctgtggtccattatctccagcccccctgcggtgttgctgtttgcttggcttgtctggctctccatgccttgttggctccaaaatgtcatcatgctgcaccccaggaagaatgtgcaggcccatctcttttatgtgctttgggctattttgattccccgttgggtatattccctaggtaagacccagaagacacaggaggtagttgctttgggagagtttggacctatgggtatgaggtaatagacacagtatcttctctttcatttggtgagactgttagctctggccgcggactgaattccacacagctcacttgggaaaactttattccaaaacatagtcacattgaacattgtggagaatgagggacagagaagaggccctagatttgtacatctgggtgttatgtctataaatagaatgctttggtggtcaactagacttgttcatgttgacatttagtcttgccttttcggtggtgatttaaaaattatgtatatcttgtttggaatatagtggagctatggtgtggcattttcatctggctttttgtttagctcagcccgtcctgttatgggcagccttgaagctcagtagctaatgaagaggtatcctcactccctccagagagcggtcccctcacggctcattgagagtttgtca

SEQ ID NO: 63 - DNA, 1410 bp, Artificial Sequence
  sequence of STAR63
gcgtctgagccgctgggaacccatgagccccgtccatggagttgaggaagggggttcgccccacggggtgggcgccctctacacagcgcgcttcctcttctctcgttagcgccgcgggaccagcctctggttctgcacctcgcgctctgggagcagcgcccggctttggcgagcgcttccccggggctgcccagcctctgctccgctcgccccgccaggcccggctccgcgaagcccccagggtccagtccaaggccccgattccccaaggccagggccccggggcagcattggaacagggcgcggacgccagtcctccgagcatggagtaactgcagcttttgagaaaagaaagcggaccccaccccatcgagaacgcggcgccttgtttagggacgttcctgggccgtcacggagtgtcgccggctcctcggcccctccctcctccaagcccccacccccgacagcggcctccctggggacctcccctcgggctgcgctttcagcccaaacacagggaggtcttccaggagcctgcccagtccccacagcagcccagagacccccactcccacctgtacctgccaagccttcagagagggcggcctggacatgccccgcacgggaggagccccgcctcagcacccctgcaagtggcagcaacccagaacacccgtgagaggcctctgagcagcccaggaagtggctggaagacgcataggcagctcactcctctgtaagagcaaggaccggagaacacatgctgacccctgcttttgcagaggggcgatgcttcaggacaggcgcgctcagcaggtgtccatcttatttcacacctttgtgtttatatcatcttattttgcattttatgtctaattaacaatatgcagctggccaggcgcagtggctcaagcctctaatcccagcactttgggaggccgaggcaggtgtatcacttgagggcaggagttcgggaccggcctgggcaacatagcaaaaccccattgctaataaaaatacaaaaattagccagccatggtggcgggcacctgcagtcccagctactccggaagctgaagcaggagaatcacttgaacccaggaggcggaggtggcagtgagctatcaagccattacactccagcctgggcaacagagaaagactgtctcaaaaaaaaattaatacgcagcagaatattatgtggtcagcccaagcagtcccccccactcagccctctgtccctacagctccaggcactcccccagcccctcccctggacaagaggtaatgcccagagggtgaaaatccaccaaggttaagccagaaacaaaaagctcaaagcttcggcatctccctccgctcagacccttagagcagattcctctcatcgacagcacgatcaggctgtgg

SEQ ID NO: 64 - DNA, 1414 bp, Artificial Sequence
  sequence of STAR64
agagatcttttaagggctcaaaagaccctgcggctcccctgccaatagctctgccatcgtccccagagctttcgaggaccctccaccatcggcgccaaccccagctgagctgggtgctcgtctgcaggcctctgctccatctcagcctgagcatgaggctctgctgtgctgcttccagcagcagggacagggctgatgagcctggcccttgcaagcatcttcctgtgccgaatacaattccacagacagaggatttaaaatccaagtggaggtgacaggaaagaaaggaaaacctccaggtatcagaagaaaggagggggtgtgaagacagtatgggaggaaggtcaggctggggctcagctctgggaagtgccagcctgaacaggagtcacgcccgggtccacatgcaagggaatgaggaccgaggccctgcatgtggcagggccttccgcaggctgccccgtctgtgaacaggacaccagaagaagtctgccttccagcctggcaaagtggcaaggaacctctgggtgggaaaacaaatcaacaaacaaattgtcagtaaaaaacagaaacctcacactttcctttctcttgacctcttgaaaaaagcaaatccactgcagctcaccaaaggcaaagagaaaaccttaagaatacccagagagaaaagacacgttacttgcaaaagaacatctaatgcagggagataatgaaaatacagactcttcaaagggctgaaggaaaaaaaccgtccacctagaattctatccccaaactgtcatctgagagcaagggcaaaacaaacgctttctcagacaggctggacgaggtcgctcacgcctgtaatcctagcactttgggaggccaaggtgggaggaccgctttaagccagaagtttgagaccagtgtgggtaacataatgagaccccatctctaagaaaaagaaattaaataagacaagactttttcagacaacaagtgctctgagagctggcctatcttggctgtcttgtaaagaattgctgcgagacacctcattaggaaagagactgaatctagaaggaaagagcagagcatgaggtacaatgaggagcaaataaacaggtcaccatataagcaaacccaaatacacattcactatacgaaacaataaaaatgactcatttggggggttaaaacactgttgaactaaaatcctggataacagcagcatgaaaggtggggtggtggtcccaggaaagcattcaaaggtccatgtctcatttgggaggagggtagggagactcatgaacttgaggctcccttcaggcaagcacagtgcaaaaaaattataataatgggaaacagatacagtagactgtgatgtacaactctcagagcagtagaagggagggtataaaacaaatctgatcca

SEQ ID NO: 65 - DNA, 1310 bp, Artificial Sequence
  sequence of STAR65
tcgagaccagcctggccaacatggtgaaacattgtctctattacaaatacaaaaattagccaggtgtagtggtgcatgcctgcagtcccagccatttgggaggctgaagttggagaatcgcttaaacctgggaggtggaggttgcattgagccgagaagcactccagcctggatgacggagcaagactgtctcaaaaagaaaaaaaaaagaagcagcagcaaatatccctgtcctgatggaggctatataacaaccaaacaagtgaatgcataagacaatttcaaggttatggtagataccataagtgggagatgaacaatgagaacacatggacacagggaggagaacatcacacactggggcctctcggggggtggggaaatagggggtgatagcattaggagaaatacctaatgtcgataacaggttagtgggtgcagcaaaccaccatggcacgtgtatatctatgtaacacacctgcacgttctgcacatgtatcccagaacttaaagtataataaaaaaagacattaaaaaattatgatataaaatcccaattcaagttgttttaaaaagagaaaacaattatctttatataatagcggaaaatatagatggcggaattaaagcctcgtcatattttctaacagaactttctgataaacttgattaaataaaaattttaaatatcactaaacacatagaagaaataaatttaaaccttcacaaaaaataaagtacaatgaatgaagacaaggtgtacttgaaaaaagaactgaataaatattctacatataaaaaaaatctgatgatattgtggtgattctttactttgctactagtttctctttttttcttctgaaaaatttcttgggatgtatttggtttcattagtaaaattctaagtttctttgcaatctgaacattggagcttcatccatagccagtatgccctaacattatctttggacaactgtaaaattagaacactgccagacatatttaatgtatgatgtatatcaacactgggacacattttatactatctttattccaaaatcaaatgattcactgtggtttataaatgtacatggatatatctctacctaagcagatagttaggagagttagtaaaaatgaggtggaaaataggagtcactgtcccttcacagggagagaattctgcttttctcctaatataccctttgcttgaacagactccaacccctcatcttttgtcctttaaatgaccacatttattttaactttgataaacaacacagaaagatatttgatccatcaacattcac

SEQ ID NO: 66 - DNA, 2500 bp, Artificial Sequence
  sequence of T2F (STAR66F)
gcaggttggatggtgctgacccctcctcgggttggcttcctgtctccaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggctgccagcccgtgaggtccgtgaggtcctggccgctctgacagccgcggcctccccgggctccagagaaggcccgcgtctaaataaagcgccagcgcaggatgaaagcggccagcctcgcagcctgctcttcttgaaagctgggcgggttggggcggggggcttctctggaaggcttggagctgtcccctctggccttgggggactggctgcccccggggcgcccgggcctagccgaggcggtgctcctgccggccagactctcggtcagtgcgggcacggggtcccagccactcctagggggcagcgcagccggcagggtggccgcccccgggtgggacttggaccctggactccacgggagggctccgccacccagcctggtgttacataaggggtggtggaggtgggcagtcgagcgttaaagagtaacctgctgccgggaagcccgccaagcaatcgcggccccttccccggctctggcagctctgcgagcgcgcccgtggggaacgggccctccccggcggggcgcgcgggcgcgcgaggtgggcggaggcctcggagctgtgccgggccgggcctccctccctaggccagcgcgggagcgacccggagggggcgggcccggggcggggcctcgaagcgctggccggcgggagcgcggccggccgggcccgcccgcctgcggtgtggacgccgcgcggccaatgcgcgcgccgggacgggacgggacggggcggggcggggcgggacgagacggggcggggcggggcgggccgggcagcctccgggcggcgcggcgcgggcggcggccggatccagggcgggggtcggcggcccggccagcccggcccggcccggggccgcgtcctgagagtcagccctcgccgctgcagcctcggcgcccggccggccggccatggagcgccccccgccccgcgccgccggccgggaccccagtgcgctgcgggccgaggcgccgtggctgcgcgcggagggtccggggccgcgcgccgcgcccgtgacggtgcccacgccgccgcaggtaccgggcgccggtgggcgggggcgccgaccaagtttctctcgctgcaaagatggcgtcagtgctgcccaaacttcgggcccccgggggcggggcagcggggagggcggccgcgtcggtccgcgcgtgtccgtgggtcccgccggggctgcgccgggcggccggggagcccttcccgccgcgccgggctgggggcggggccgggggcggggccgcgccgtccacaccggccgcagccggttttcgaggcgggcgccgagcggatccgcggcggaggttgagggacccccctcccccggccaccgcctccgctgagtctgccccctccccatccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagaggtgagcgggaggcccggtgcctcgggactcggtgtgcgcaggggcggtgggtggggtgcggagacaccggccccgacggaggccaggtcagggccccaggtttgtaattaccagccacccccaagctcttcagccctggaggagctgagcagaaatgatcgatgactgggagtccctacacctccctccaccgcagttcctcggggctagagctcagaacccggagcgggtggctgtgcgtctctgtgcagaagaggctgcgcggtcggcatggggcgactgtccaggaatccctggggctcctgaccgccacctcccaacccctgccaggccggacacctcggtctggctgccagggcaggggcgggccctggcctggctcgctggggcctggggagctgcccgtgcttccagcccagtctccccctggctgctgccggctgctggccactcccacctcccaggcctggcgtgaggcccacagctgctgttgcacaaccctggttaatgtgtgatg

SEQ ID NO: 67 - DNA, 2500 bp, Artificial Sequence
  sequence of T2R (STAR66R)
gtttggggtagagagaacatactgattatgggactttgctttgcagcttagtgctgtcctgtcagtgggaagcaacagggggcagaactcagcttgtgcccatagagggaatgtttatactaggcctgtccagaggcaaatcatccatcctagcaattggaacctgacttttggcaagtcctgccaccatgggctaaagtgttctggggttctaaataaacatgaaaggcaacctagaccacaaggactgcaattcctgcacaagtcctggtgctgtgttgggcttggagccagggaacttggagtgcatggaacctagtgagataccagctgagacaaccaaggaagtgcttgtgtcacccctccaccaaccccaggcagtacagattgtacctccaagaccccttccatctgcttgaggaaggtggaggggaagaggactttgttttgcaacttggattccagcccatccacagtagaataaggcaacgggcagactcctaaggcccccatcccagaccctagctcctggatgacatttctaaacacaccatgggccagaagggaacccattgccttgaagggaagggcccagtcctggcagaatttatcatgtgctgaataaacagcccttgggccctgaataattagtattggtagccaggcagtatttaccacaggccttgggtgagacccagagccatgttggcttcaggtgtgacccagcacattcccagctgtggtaactttggggagagaccacttctgcttgagaaaaggagacagaagagtaaaggggtctttatcttgcagcctggtaccagcttggccgcagtggggtagagcaccaagagagcacctgggataaacaaaatcaaaaaacctttagctagactaagagtaaagagagaagacccaagtaaatataatcaaagacaaaaaaggagagacattacaaccaatacctcagaaattcaaagtatcattagcagctactttgaacaactatatgccagtaaattggaaaacctagaagaattatataaattcctaacatatacaacctaccaagattgaaccatgaagaaatttaaagcctgaataggccaataacaagcaatgagattggagccctaatacaaagtttacaatgagaaacattgctcaaacaaatcatagatgacacaaacaaatggaaaacatccaatgctcatggacaggaaaaaatatttaaatttctatactgcccaaagcagtttatacattcaatgctattcctgtcaaaataccaatcttattcttcacaaaaaaaaaattaaaaattacacagaaccaaaaaagagcccaaatacccaaggcaattttaagcaaaaagaacaaagctggaggcatcacgttacctgtgatccacactatagggctacagtaaatgaaacagcaaggtgctggtatacaaacagacacataaaccaatggaatagaataaagagcttagaaataatgctccacacctccagccatccgatgtttgagaaagtagacataaacaagcaatgaggagaggactccctattcattaaatcaactcaagacggaccaaaaacctaaatgtaaaacaaacaaacaaaaaaaataactgctaaaaccctgggagatgacctaggaaataccattctggacagtacctggtgaaaatttcatgctgaagacaccaaaaacaattgcagcaaaagaaaaaattgacatatgggatcaaattaaactttagagcttttgcacagcaaaataaactatcaacagagtaaataggcaccctacaggaagggagaaaatattttcaatctgtgctctgacaaagtcctaatatccagagcctataaggaacttaaacaaatttacaaacaaaaaacaaacaacactattacgagttggaaaaggacatgaatcgacacttttcaaaagaagacatacatgtggctaacaagcatatgaaaaaaatgctcaacattactaatcattagagaaatgcaaatcaaaaccacaatgagataccatctcaaccagtctgaatggctgttattaaaaaaatcagaaaaaaacagatgctggcaaggttgtggagaaaaggaaacacttatacattgttggggggagtgtaaattaattcagccattgtggaaagtattgtggtgattttctaaagaactaaaaaggaattactattttacctggaaatttcattattgggtatatacccaaagaaatatgaattattttactataaagacagatgcatgcatgtgttcattgtagcactattcacagtagcaaagacatgttatcaacctaaatgcccattaacagtaaactggataaggaaaatatggtacatatacactgtggaatactatgcagtcataaaaagaatgagataatgttcattgcagcaacatggatggaactggagaccattatccttgggaaactaacaaagcaacag

SEQ ID NO: 68 - DNA, 2501 bp, Artificial Sequence
  sequence of T3F
agatttgccctcaagattacaactgctggggctaaagtggtacagagcctgagttcagtaggcttccatagtctcactcaagaatgcaagtttacctctcaatctttcaatcatcacaattataacaactttaaaaagagccaacatgatatttgcttatcacttttctactcacattccagtattaactcaaaagtgtcaacacaaccttcgtgataaatactattaacgtcatcattcctactgtacagatgatgatagtgacacataggttaagttgcccaaggtcttattattaagggtcatagccaggatttgatctcttcagtaaagttctagtcaatgctcttaaccattaagccatgcaacacacccagagccaactgggttgtgttgatgattataatatttgttttaacaaacaataatttttcctaaatataatatagattttccataaataccataaattcttgattatttatttcactttattccaaaaggaagttgaattctgagatttaaatgaatagcaaacaacagttgcttaatttcactacttttgtcacttgtagccagtacttaaaaagagatacataatttatttttgttgatttgcatttcacatataattgtaagatcctggagaataaagactatatgtgttataccattttactctctcacacagtgtgtaggcctaggctttgtgcatagcaagtgttaaaaagtaatgtgactcgtgatagttattagatttattgaaattcagaaatttagggaaatgcacaataaaatgtacattttgtgattccggtcaaattacttaaaaattatatttttcctatgaataatttttatttcacttaaattatgtataacaaaataacatgcataattaaacatttaccacaaagaaaatatttgtactattgttatcacaataaagaacttgctacataaattcaattacacttttgtggaaagtatcttcattatataaaaacaatctacatttagaataggaaaattgtacaaaacatgaaaatataaacaaattaagcgagaattatctaaaaagcaactcttcagaatttagaagaattgtctagaataaaaagaatttagaagaattatctaagaaacaaccataaatattctgatgtatttaagactcatattctagaatcctgactattattttttatacttctatggctaatctcaagtttagctttatttttctaaagcaatgaggcctgtagaatattttttcagaattctctgaggttttttcttttttgtctttcctgtcatagtatgccaattattcatgggtttatagaatatgtatgcactgctaagagcagcaaaacaaaagatatatgtgctatttattaattcatgttgctttatttaaattacttgaaaatgataaagaaaaaactattgtatttacaacagcaaccaaatatagactacctgtaactacatctaacagaataaataaaatataacatacaatatgtagtaaatatatttataatatatatgttcactaaatagttaacctgtaacttacttacagtaaatatatataatatctactgagatagtaccacattttattaaggattaaacttttaataattcagaagaataaatataataaatttcatttgttctcaaactaatttgtttttatttgtttgttttttgtattttaatttgacagtagttccaagatattttggggtatataatgaggtgataattgcaaagaaaattctgaaaaggaaaagactaagcgtgaattgaaagtaaaattcgttaaaaggtataataaactgtgatactgtaacaataattgaaaatagataaagaaaaaggtaacatcaataaatagtctattatatatgtgaattatgttaataaaagtgacattttattttcaatccacaatttctgaaatatatatggcaatatttttctgttttattttttcaacctctgattactttattacatttttttctttttctagaatttacttgtattttctctgtgtctaatatatgattatttctgaactagcatcattggtcctggaaccagactatattattcccaaggtagagcatcaaaatataacaattaaataaatacttttagttactttaacaaccttttgtctttcattataattttggaattatagtttagtacaatacagatagttttaatatctgttagagtgaagatatatatatatgtgtgtgtgtttttgagatggagtctcactctgttgcccaggctggagtacagtggtgccatctcggctcacggcaacctctgcgtcccaggttcaagcaattctcctgcctcagcctcccgggtagctgggactacaggcgagtgtcaccacgcctggctaattttttgtatttttagtagagacagggtttcaccatattagccaggatggtctcggtctcctgact

SEQ ID NO: 69 - DNA, 2511 bp, Artificial Sequence
  sequence of T3R
cttttggtgccctgtcccttataatttcctcgtgtgtcctttcccatttgcttatccgatgacttgcttctctcacccattggattgtgagcctcttgtggtcaggggcagtgctctgtaagctgctgtgtccccagaatctggcccagtgtaggcactcagcagctatagactgatgttaagagaaaatgcacatttcatctcagcctcagagcagttctgggaaacagataggaaaccaaagctctgcaagaacgtgggactctctcagggccatcacaacactgttgttggtctcatgtttggtgactgggtctcctattcctggtctctttcctaggcataatgcttttatataaagtcccttccattgtttttttgtttgttttcttttttcagcctaaataacttagtttctctaaacttttctcccagggactcttttttaaccctttgaattattgctgattattatcttaataacttttattttttttccattttgcatgtcatattttagcaaagcattaaaaggaacacggcacaaagcacacccatatttttggatgctgtggatttcatcatgctgcttattccattatatctagtcagtacctccaaggcattaatgctgccttacctccttcattcgaagacttccctgtgcaaggtggaatatacgtaaggaggcaaacagactgggttatatgcctgctctgctttacagaggcctcttccaggagtgtaatacgggggttgctcatactctgaagaagatagtggcaggctattactgtcatgagagccagaacgtggctggcttcttacagacatggcttcataggggcatgccacgtgattcctgagtaagccttctggtgtgaattccctgctcactggggtgattcttcacttcccacagttcaacctgctgtattatcctcttacctatgcttttctgtgatccatagaggtaatttaattttcagtccatgtacctaccctgcctacttagtttcttctcagtgccacacttaattccttcacatttactgattaattaaatgagaagactatgccaggtgaaggttcagcatcttcagaactctacatgatgcattccctgaggctgcctttcaataactgaggtgatattctttgagcagtgtgacctgttagaggtgcccagtcaggtccgatgaaaagccctctgatttgttgaaatagtgcattagtaaagtattatagtttattttcacaaagctagattagttgttacatgttggtttttgttttgcctagccctaacaagtatggaggtgaccttgatgtgtctatagaatatcaggaatatctggctgggtgggtggctcacacctgtaatcccaacaatttgggaggccgaggtgggcggatcacctgaggtcaggagtttgagagaggcctggccaacatggtgaacccccgtctctactaaaaatacaaaaattagccaggtgtggtggcaggtgcctgcaatctcagctactccggaggctgatgcaggggaatcacttgaacccgggaggtagaggttgcagtgagccaagattgtgccactgcactccagcctgggcaacagagcgagattctgcctcaaaaaaaaaaaaaaaaaaaaaaaaaaaaaaagaatatcaggaatatccattttatgtctcaactcacatacctcacagttttctggtccaatttttaggcactttatcaggccctcatatgttttcaaaaataattgctaatgactttgatgaagctaggcaagatattttttggttttagggcagtttgggctatagtttgcagccttcctactttaatagaagaatttttaaactagattctcccccttctcagggtggctttctgcctttccattctagtgcttcacacagaaatgacaagctcacaggggacttatctagaaaaggccgagataaaaataagtacaatgttaaaaaaatctatcttatagtatcatttatttagagcttcctctccttttctaatgaaaggctgctgtagtttccttttgtgctttttttgctgaaggcttttcagtaatattcccgtgtgtcccctgtgatgctaaaagcatgagcttgggggcaggttgactggcattcaggtctttgctcagcctccagccgcaagacaaggcgaataatattgatctcatggagctgaaatgaaaattaacttttctaatctgtgaaaatgctttgttataatccttaaatacatgaatacataggttgaaatagcaagtaccaagtgctgacattatgtccacaattgccacatgccatgtccttatgatttttgccagatgtttaataagattataaatgaataggttattaaatgggcatctcctactctctaggtgtttctgtttctgcttctctgttttctgtttgtatctccatttattttaatgcctaccattatgtgaagtctgccaccttcctatac

SEQ ID NO: 70 - DNA, 1500 bp, Artificial Sequence
  sequence of T5F
gaactcaataggggtcttgtacggagcaggggcttggtccctcgtacctctggccatacctatggagcccaggggatgcttggcagcacctgggaggtgccaaccccgggtggcaagggagggccggtcccacgctcacattgtcttctgttctctctctctctttatctgtgtcgatgtctctctctcttcccccgtgcccgtgccatcctctccacccctggattcctgtctctgcttggctttcacccacttctcctccccacccacggctgctcctcctcctgtccccacctcctccccgggtgcaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaaggtatgacggccgcctgggcggggctgggcctggccgtccattccttgtggccacagcctcccgtgggcagaaggatctgctgagccggcctcacggctacccgcagggacccagccctagtgtttcctgccagtttctaaccctgggtacttgcactcatgacccctccaggcccccatcccagaagacttgactccaacccaagcctccttggtggcacctatgctagtgatgaagatgatgttaaggagatggcagctgtttactgagcacctactatgtgccaagcacacgctaagtgcttgcccttactatctgactcagtcctctcaaccaccctaagacgtgggtagtgttgttattcccattttgcagatggcaaaacagagtctcagaaaagagaagcagagtgtgattcagttttaggaaggacagaggaaggggtctgaggtcagggcctcctgggcagggggagctgtcctagttcctcaaaaccaatttgcctgaaagcatattggattactcactttacagtaatccgtgcgtgagagacaggggcggtctcttttgagttgtctgtgactttttagatgcctttttcctatttgtctgcttttgggcattttgaggatttttagccaggttgtctaaagcagttcttcccaggggagtgcgagagaatcagttgcctgcaggagcttctccagcaggctaaatcagaggtgccaggggtgagcccagcctcacctatatctgaaggacttccctatgctggtgggtggaggcacatccaccttagcattgagtttcaaataagcatcaatcatctccattcctttttttttttttttttttttttgagatggaatcttgctctgtcgcccaggctggagtgcagtggcaccatcttggctcactgcaacctctgcctcctgggttcaagtattctcctgcctcagcctcccgggtggctgggattactagcatgtaccaccacacctggctaatttttgtatttttagtagagatggggttttgccacgttggcca

SEQ ID NO: 71 - DNA, 1500 bp, Artificial Sequence
  sequence of T5R
gattacaggcgtgagccaccacacctggcccagtggggtccttctaaaatgcaaagctgatcatgtctcttcttccaggcttaaagccctcccatggcttcctgcagccctggtgcacgccttacgccaagcctgaaaacactctgcacacccaccccttccctgcacaaacgggcctctgcacactacctgccccggccatgcccccgcaaccagccctctctgcttatctaccttggccttctctctggtcaagccccaggcccgtccctgcccctaggccttcacttagagcctcagaagcacttcttgcaggaagccctccagactccagaatgggtccagaacctacttccttttcgtggcatttctgtattctttttttttttcttccatagagccagggtctcactgtgtttcctaggctagtctcgaactcctgggctcaactgatcctcctgccttggccttccatagtgctgggattacaggcatgagtcattgcacccggcctccacagtcttaattaattggttggagcattatttgcattaatatctctcaccaccctccccattcctgtccaagacctcagggagggccaggccagatgtatcatctgcaccagggagtcccctgcaggggcttccagatgtctgctaaatgaacacacagctctctctggccagtccaaggcaccccaggaggccaccagaagcctgcagcctccctccctccctcctgctaagcccaaggaatgagcactgagcagggaatggtaatctggacacatccatactctgcccttcagaaactacctagctgtcaccctgcacgaaacaggcaccagcctgagagtcaggaggcctgggctctgggtccacctagacagctgtggggcgcaggaccaaccgcaccccaatctctaagcctgggtttttccatacgtaaaaaaatgagggcagggcgggttagacactagaccagatctgtgatgacaggcccgttggaaggctggaggcggggcccctcgctgaaggaaaatgccttacctccagaagtggcccgccctggagtggccagcaaagggggcattgcccctgcgctggaatacacccagaagcagggtgtgagcaggagctgcggagaccttcagggacaggacagtctagggagggggtgagccctttgcagatctcctgcttatgccaggagaaaggtaaacacctctcaaacacacaaggagccagggggctgtgggctggaacctatagccggcaacagcgtatagcttaggattttatagcattgttctaccctagttatgtttcctatacttttgtttgtttgtttgtttgtttgtttgtttgtttgaaatggagtctcactctgtcgcccaggctggagtgcaatggcacgatcttggctcactgcagcctctgtcttccaggttcaagtgattctcctacttcagccttcctgagtagctggaattacagg

SEQ ID NO: 72 - DNA, 1199 bp, Artificial Sequence
  sequence of T7
ccatcttataaatatatcataatttactgaaaaatatttcagtaatgttgaaaggcctctgtgccatttccagcttgaggctattcctaaaaatccttgcacatgtctttcagtgcacacatgtatacatttcggttgggtatgcctaggagtggaatgactggttatagggtacacttacgttgagctttggtagatactaccaactgccagttttccaaagttgtaccaatttacattcctaccaccagtacatgagggttccagatgctgaacgtcctcactaatgcttggtaatgtctgcctttttcattttagtcattctggaggtagtgtgataatatctcatcgtggttatttgctttagcctgatgattaacgatcctgaccattttttggaacatttggagatcatcttttgtgaagtaactactcaaatattttgcccattttgctactgggttgttcaaaagattcattaaaagaacttcttttatatatgggtttgtagttgttatttagatattctagagactagccagatccctatactacaaatactttctcctactttgtagtttgcctttttactttcttttatatacatataatttttccccctccaaaagacagggtcttgctctgttgcccaggctggagtgtagtggtgcaatcatagctcactgcagccttgaactcctaagctcaagcaatcctccttcctcagactctggagtagttggaacaataggcacatggcattatgcgcagtcaactttaaaaaaaaaaaaaattgtagagatgaggtcttactatgttgttgcccaggctgatctttaactcctggtctaaagcaatcctcctgcctcagcctccctcccaagtagctaagaatacaggtgtgcaccaccacatctagctttactttcttaatggcgtcttttaatgaacagataattcctaagtttgatgtagtcaaatcatcattttttcctttatagtcagcatttatatccagttcaagtaaagaatatcatgaaaacattcttctttgttttcttttagaaactttcataaagtagcatttaaaatgtgaattttcctataatcctagcacttcaggaggctgtgccaccgcactctagcctgggcaacagagcgagaccttgtctcaaaataaaaaattaaaaaaaaaaaat

SEQ ID NO: 73 - DNA, 1602 bp, Artificial Sequence
  sequence of T9F
tgagcatctctgaactattgcgccatgtatttccaattttcatattgtgtatttgtatattttatatgtaatagtataggtgtaatatgtaaatatattttatatgtatttaaaatctttatattttgaagggttttgtttcaactattacttgttaatttcacagtccctttctttgatgttagcaaatagtaccttcatgaacctcagaggacttggatctgaatgtgcaatgccctctagtatttcaaataatagttcagttggtatagtatttttttaatctgcaaaaaacaatacttgctaatatagctatgttagagtaaacaataaatcgagaataaatttatagcctttgaaacaaaacaaaccaaaaattttactcctttttggctttcatccctgcactggtatcttaacttctgtttgtataaaagaataccattttttcacagaagacaaagaacaatcagccaatctaataattattttatggccatgctctgaaatacaattaaaattatgattgtggacaatatgccttttcgggacctggctgatggtatttctggtgtgaccccaactttccagtcagttcagggcaataaacattggatacaggacagctttggggatgaaatagaattaaatttagtgtagtttttgccacttttagctggatgcctggcgaggggttttgtgccctctgagagcctccgtcttctcaactgaggggtggttgtgagttttgggtcaaatgcttggtgtttagtagatgcttggagcttccatgaaacatgcaaccacggcgttgctgctatttgttcagatgcgagaggaacatgacttttggctgcctgagtgttctcatagcatctgggccttccttgtgagatcgtcagaaagtgtttcctgcacaaagcctgtactgcggccctggcgtggggctgattgtcccgctactctgctgtgatggctgaattcaaagagtggccgataggagcacgtatggtgggtgccttgttaacagctcatagcagaaacgtgacaagcgggagagggctttgggttgtcctgaacttcaaacacctgtaactgctgcgggaagagcggcacgtggatgaaacggacacagagggggaataggcaggaaaggacgcgggctcttttcgaagcagcaggtctcaaggcggccagccactggcgcagctgcagctgaagccacggcagagtctccatccttcccactatctgctgaatcagagaaagtggcaggcaacatttttagtgccttaaatttagaacgcttgctcaaaatcagaccctacttaaaataaggagcgataccctcatttcttaaatagtaaaaatgccctcagcagaattaacgggagtatcttccaacttcatatcctgaatggaaaagtctgtccaccatcccgaggacgtgtttgaagcgcagtgtgaaaatccagcacgtcgtggaccggccagacccctgtgccgtgagaggcggggcggcggggccgtggggcgctcgcactcccgagctcatcgtggcatgcgctgagccgaaaaccacgaggtagagggaatgagatc

SEQ ID NO: 74 - DNA, 1602 bp, Artificial Sequence
  sequence of T9R
gagcttgattgtctggccgcgaaaacagggcaggcccgtgtccaacatgatagtgaccagggagacgaccacatccatgtagggcctggggagagacaggagggagcggtgggctgaggccagcctaggtggtggccctgcctgtagtcctgtggactggctgatgccaacagcctcaggtgtgggctcctgccacccacctcgcctgccacatcttgcacatccccgaggcaactttcgatctgctgcactcggtcacccgtactgcccaggcaagggctgcccatacgcactctggacaggctgagtgtcctgccctgtcccccacataaggctgccggccatggcttctgcacctgggtgggatgcagacacgctgacctgcctttctctgcggggcagtggggatgaacccaggttggactgtggccttggccaagtgacctgtatatgaaactgggacaaagcccatctttggcacgtagcctgtggggtggcaggtgctcaggctttggtgacaaggtggatgggatgcccagaaagggagagcccatggctgaaggcgtgggcaggattgtggggaaggtggttggaattagatgcccagagcaagaatttattggcacaggtgggcagacagaggtgaccaaaggacaggtgtaggtcagcaggtggctgctagcacctacctcactctctggaacccgattcccttcatcctaaaggggatctcagaacgttccacacaccccctccgcctccaccctggccctcacccaggctcaccgcacagccaggtagcctggacacacatctccatgaaccacttgaagggtgtggcctccatcttgccccccatgatcatcaccatctcatccgtcagcttgatgtcgggttcccagccgagattgccgcccggcgagctttcaaacatgaagccaaagtctgcaaaaccccaaagagctgcctgtgactgggtaggagccagggcgggcaaggacgagtggtctgttttgaggagtggaaaaggactcttcaacaggagcaccccctccacccccaaaaggcaggttgtgttttcttggagacagtgatggggtgggtggtggggcagcaggcagagaaagagaagggaggaagtggaggaaggagccaagctggggcactgaacctggaccagccccactccgcccagctccagcttctgactcagagcaatggcggctctcgccccagctccctggggccggggccaggcaccctctacagcagaacagcttggtggccgacagttcggacctcagagctggaccctgacactcctggcagggtggtcctgggcattctcctctctgtggggtggggatccctatccacccctgggtgccggggtgaagggagaggagggtggcgctgtggctggctgaccgatgtggatgatatggcccttcttgtccagcataatgttgccgttgtgtctgtccttgatctgcagcaggaacagcaggaggctgtaggcggccatgcttcggatgaagttgtagcgggcctgtgcagagagcgccctgggctcaaaaaggccctggggcctgtgggcattct

SEQ ID NO: 75 - DNA, 1301 bp, Artificial Sequence
  sequence of T10F
aatcaaactggacccttatcttccaccatatacaaaaattaatgcaaggtggattaaagatttaattgtaaggcctcaaactataaaatcttaaaaggaaacctaggaaataccatctggacatcagccttgggacataatttataactaagtcctcaaaagcaattgcaacaaaaaacaaaaactgacaagtgagacctaattaaactaaagaacttttgcacagcaaaagaaactatcaacagaataaacagacaacctacagaatgggagaaaatacttgcaaactatgcatccaacaaaggtttaatatccagaatccataaggcacttaaacaactcaacaaacaaaaaacaaataacttcatttaaaaaaagacatgaacagacacttctcaaaagaagacatacaagtagacaaaaaacataggaaaaaaatacttaccatcactaatcatcagaaaaatgcaaatctaaaccataatgagatatcatctcacaccagtccaaatggccattaataaaaagacaaaaaacaacagaagctggcaaggctgtggagaaaaaggaacacttatacacttttggtgggaaagtaaattagttcagccactgtggaaagcagtttggagatttctcaaagaactaaaaatagaactaccatatgacccaacaattccattactggttagatacccagaggaaaataaattgttctacaaaaaagacatgtgcacttgtatgttcattgcagcactattcacaatagcaaagacatgaaatcaacctaggtgcctgtcagcagtgaattggataaagaaaatgtggtacatatacaccatggaatactacacagccataatagaagaatgaaatcatgttctttgcagcaacatggatccagctggaggccatcatcctaagcgaattaacagaggaacaaaaaaccaaataccacatgtcctcacttgcaaatgagaggtatatatagacataaacatgggaacaatggacactggggactcctggaggagggaaagaagtggcaggcaaagggttgaaaaactacttattgggtactatactcactacctgggtaatccgctagtagggatcatttgttccccaaacctcagtatcacataatatacccatgtaacaaacctgcacatgtacccccgaatctaaaataaaagttgcaattattaaaataaaataaaaataaagctagcaatgagccctatacatgaaaatcaataaaacataatcatggctgtatagaggggcttgtcatttatagc

SEQ ID NO: 76 - DNA, 1300 bp, Artificial Sequence
  sequence of T10R
aattttacacacacacacacacacacacacacacacacacacaatatcgctcagccttaaaaacatgctactaatcggctttaagaaaagaagaaaattctgtcatttctgacaccatggaagaacttcaacattacgttaggtgaactaattcaggtacagaagaatactacagtatctcacttatatatggaatgtaaaaatgttgaactcaaaagtagagaatggaatggtggttaccaggccttgagagagaggggtaaaggttggtcaaaagatgcaaaatttcagttaagaggaaggagtacaagagatttattgtacatcatggtgactataattgataacaatgtgcttttttcttgacaattgctaagagtagaatttgtttatgggcaccaagcttgattccaagtctttgctattgtgaatagtgctgccatgaacatgcaaatgcgtgtgtctttttggtagaatgatttgttttcttttggatatatacccactaatgggattgctgggtcaaatggtagttctaagttctttgagaaatctacaaactgctttctgtggtggccaaactaatttacactcccattaactgtgtctaagtgttcccttttctccatgtcctcaccagcatctgttgtttttttgactttttaataatagccattctgactggtgtaaggaggtatgccattgtggtttgatttgcatttctctgattagtaaaatgaagcattttttgtatgtttgtcagccatgtatatgtcttcttttgagaaatatctgttcatttattttgcccacttttaaatgaggttatttggttttgcttgttcaattgtttaaattctttatcgatgctgtatattagacctttgttgaatgtgtagttttgagaatattttctctccttctgtaggttgtctgtttactcttttgatagtttattttgctgtgcagaaactctttagtttaattgggcctcatttgtcaatttttgctttcgttgtacttgcttttggtgacattgtcacaaattctttcctaaggtcaatgttcaaaatggtgtttcctaggtcttcttctaaaagtcttatagtttgagggtttacatttaaatctttaatctatcttaagttaatatttgtatatggtgagagaaaggggtccagtttaattcttttgcatatgactagccagctatcccagcactatttattaaatagggagtactttcctcattgcttatttttgtcgactttgttcaagatcagatggctgtaggtgtgtg

SEQ ID NO: 77 - DNA, 2001 bp, Artificial Sequence
  sequence of T11F
tctttggggtatgattatatgtctaggtaaaactcttttaagaagatgaagcagagaggattgaattgacaaagacagctctttaaaaattaaggttatttcaagactaagaacataactgcttaattgcaggtaataacagaaaaaacttggaaataaacatcccattatttgacctccaaggcagaagactggcaccaaggaaatggcagcttcgtccctttcctgtcttgggcattggtaaaaggagttgtctagacatgtttgatttctgtttcagcccttattagtagttatgccatggcaaattattcaatttctctgactcagtttccttattcagaaaatggaagcataattcttgcctcatagggccatgaagattaaatgaggggtgtcttgaagtgtctgggacataaatcttcaataaaagctaattccttttttttacagttatctcaaaccttttagtgaattggtgcttatcagtgagctttttaggtgatgcaaagaccctgctttgctcattttaaggaacagttatttttctttctccattttgaagtttcttgtttgctgcctggttgatatggtttggctgtgtccccacccatatctcatcttgaattgtagttcccataatccccacatgtcatgggagggacctggtgggaggtaattgaaccatgggggtggttaccctcatgctgttcttgtgatagtgagtgagttctcacaagagctgatggttttataaggggcttcccccttcgcttggcactcattctctctcctgttaccctgtgaagaggtgtctcctgccgtgattgtaagtttcccgaggcctcccggccatgtgaaactgtgagtcaattaaacctcttttctttataaattaccaagtcttgggtattccttcaaagcagcatgagaacagactaatacattggtttaaattagaatgccaaaatttaaataatttttatcttgaatagtagatggaattaactttctcttgaaagatatattttaaaaaattgaacttacacagacagttttgaaatggtcttattttagttttatttatttatttattttgagacagagtctcacagtgtcgcccaggctggagtgcaatggcacaatctcggctcactgcaacctccacctccagggtcaagcgattctcttgcctcagcttcctgagtagctgggattataggcgcccaccaccatgcccagctaatttttgtgtttttagtagagacggggtttcaccatgttggccaggctggtctcgaactcctgacatcgtgattctcccacctcggcctcccaaagtctcaggattacaggcatgaaccaccgcgcctggctgaaattgtttttattatagatgttgcttgtgcagttttgttagaagttcgtgacttttaacagtgatgaaaatacttcgtcattcaacaggttatttttctgctggttgtaggttatttgtaaggaactgttagtctcctatctgggtggacatgtaatagtatcagttactgaaccagaactttaaacacctttctgatactcacactgggaggtcaccaagtatctcagaataaaatgtcccaaactgaacctaccatgttcccagaaacccagcccttctcaaattcccagacttggtgaatgggagcctgtccttgcagtcttgtagcccaaaacctagggcttaagaacaccttcttccttactcccatatgcaacccatcaagttccatgcatttcatctcctaatctcaaatcccttcacccatctccacagccaccccgctagtccgggctgccattgtctctcacttaaaatgttgttattgtctaactgaccttcctgaaccctttcttgcctctttccagtttattttccacactacagccagaaaaagcttttcaaaatacgcatctggtcacctgcatacctgtctccagaccacatacaataagccttca

SEQ ID NO: 78 - DNA, 2001 bp, Artificial Sequence
  sequence of T11R
tctgccagcggctcccgcgccaggtcctcgaagcgcaccaggcggtagcggccgcgcaggaagggtggcggcttgagtgtggcggcctcggcgatgcgcacgtggctgcggcacacctcgcgaatcaggcgcaggtgagggtcggcctccacccacttgccgttggtgcccagcacgatgccgttgtcgcgtgccagtatcgggcccgccgcctcccgggagcgcagcacggcccgcgggtcgcgcaccaggtgcacgatgcgcaggttgagcgcggggtcgctgagcagcgggtagagcacctgcaggttgaagaagcgcacctccttgagcaccacgtggctgtaggagcggcaggcctcccgggccaggctgaatggctgccgcgtgcacagtgtcttgcatacgtcctgcttgctgatggtgcctcggggaaaggcgctgcaggcgggcggcgagcacagcgcgcggctcgttgcccagttgaaaaaggcggacaggtttcggctctgtggcatgtaggcatcaaacacgtccatgtcgcacaaaaagatagagcgcatcaggtcgcgcacggccatgtgcagcgttgccgcgctgccctgcgacagggtggtccacacatgccacgcgggctccatcaggtagaagacgtcggggtgctggctgaagagctggcccaagaaggatgagcccgagcgccacgaggacagcaccagcacgtgcacacgatcctcgccgccggctggggatgagggccctggccgggagatgatgaagagcaggaggcaggtggtctgtgccaggaggagcactgtcactgtcttgctggagaaccgtggcagccacatgcgggcggctgggggccttcgggtggagtgggcaactttagggacccgggccctcatgcccatcccatgccccaattactgcccagtgccctcagggatcagccctcagattcggctaccctacccattggacttcccaagactcccaaggtctcagtcgagcactttcccaggaatacggagtcaagacataggccagaatatagtctgtgctcacagcagaagtccagttgcagaataatgtgggatatcatcaaactgtctacctacccacccacccacctacttacatacctacaggctatctatctgtagagagaaatactatgtttcaaagagaactcctgtcttttgcttcaggatacctcttagagagacccttttaggttgtggagctaaaagggcttgatgggggcttcggtggatgtcagagcaccaccaggctcgccgaggttgaatcctggctctgccacttcctagcctatgatcttgcttatgaagatcacttaaatctctctgtgacggatcactttacccgtgtgtgaaagagggataattccggtacctggctcacaggatctggggggattggggggttattataatgaagatgggggaagggaacacgcagtcatgcccataactgaggattgcaccttttacaaggtgtgcttctgtattatataatttttttaacaggcaggtataaaacttttgtcagccaggcgcggtggctcacgcctgtaatcccagcattatgggaggccgaggcgggcggatcacgaggtcaggagatcgagaccatcctggctaacacagtgagaccccatctctactaaaaatacaaaaaattagccaggcgtgatggtgggcgcctgtagtcccagctactcgggaggctgaggcaggagaatggcgtgaacctgggaggcagaggtggcagtgagctgagattgcgccactgcactgcagcctgagtgaagagtgagactccgtttcaaaaaaaaaaaaaaaaacaacaaaaaaaaaacttttgtcattaaagataaacaagtaaataaagtggacaaagaacagcaactgttgtcatcactggtggggagtgaagtgctgtaggcagcatgggctccagaaggagggtgtcctggag

SEQ ID NO: 79 - DNA, 2100 bp, Artificial Sequence
  sequence of T12
tggcatccagcatggagcccacagcttccctttgtagaattgcccagttgttgcagagtgctttggtctcaatgggtctaaagctcttgatgatataagagcttcaacttccttttccctctcctccccgcaggctgcacaatgtcctggtgaatcacctgggacttcagagctctgccaccctgggtgtgaagctcaggtctgctcttggtagcttggtcagtgtgaagtacaccgtgattttgggcaagctgcttaacctccctggccctccgtttcctcatctgtagaatggggatattcacagaacctacttgtagggccatggtgaggattaaatgatgaacagtgctggcaaacaggaaatgctatataagtgtccctagcaatatacacaccgcacatcctcagtcaccacgtgtgttcactgaggtatgggccatgtgtgggtggaattgtgttccctaaaaagatatgttgatgtgctaacttgaggtccctgtgaatgcaggaaaccaaaatatttcttctcaaaatagtgaggattgttaagttaaagacactgaaaatgcaggggaacactgccttggcctctacttgcctgatgacaggcacgaatccttccttacttaagacacatcacttgcttatcagcccagagaaagcacctgcaggcaccaggaaaatctaggaacagattttactctcttcccacattttcccactttttcaaacactgaaactgctctctcctttgtcttgtcactagataggatttatggctctttgttaaaatattgtttaagcaaggcttctacgccactagcttgagagagaaatacttttgaactgaggcctcttccgcatgataggcagagcatgcattaatacatttctgcttgtttctcttttgttaatctgacttttgttttccagagtgtctcaaataagaacataaaagggaggggagaaattatagtttctcccctacatgaacttattcggatatagggtctttgcagatgtaatcaagttaagatgaagtcatatttgattaggataggccctaattaaatatggttgctgtctttataaaatgagaagaagagaccaggtgtggtggctcacacctataatcccagaactttgggatgccaaggcaggaggattgcttgaggccaggagtttgagactagcctgggcaacacagcaagactccatctccaaaaaaattaaaaattagctgggcatggtggcatgcacctgtagccccagctacttggtgggctgaggcaggaggatcaattgatcccaagagttcaaagctgcagtgagctatgatggcaccacggcaacctgggtgacagagcgagaccctgtctcttaaagaagaaaaaaagaggagaaaaaaacagagacacagaaaaaagtccttgggatgataaatgcagaaattggagccatatatccacaagacaaggaaccaccaggattcttgggaactccagaagctaagaagagggcatggaacaggttctaccctagggccttcagagggagcgcagccctgcagacaccctgagttcagacttctggcctccagaactgcgaaagaataactttctgttgttacagcagccctaaggcactagtacaggtgacatgtattgctcttctgaagagcagggtgtctacagcggcagaggtctgggtcctggcacgtgccctttaggattccaatatccttaggggcctgctggtgctgacagttccagaaccataagacagaattcctgcgggccagtttggaagcagagacaggaaactggaagagcccttagcctgtgcttgggcttaaagccctttagcttgtggctttaactctgaaacttctagagggcatcttgcaggtcagtgtgaggtacagaagttgtcacaagcttcctggctcaaagaaagtgagacttcacgaacttttctggacatcacaccagcacttatgaagttatcttgttaagcacagatgaaatcagaaatacaggcattcaccatcacttaaacaaagctcagattgtagagtgcgaggaagaatcggtggga

SEQ ID NO: 80 - DNA, 1700 bp, Artificial Sequence
  sequence of T13F
cagatctctaaagtattgggtgtggactagagctctggacggcctaaaggaaaggaatgtgccggttcacagggacccgcggctaagctcaagggtaaaatacagctttacaaagcatctttaggctgttccttcccaaacgtgcttagaagggaacagggaaaggcgggtgtgttttctcactgaggttcttctagtggctggaatctgatagagtaccaagttgtagggatatggatatattttccctttggcactccataaagctaaatgttgggctgaaaaaaggatgcagcctataaacaagtatttttcctgaaaccaactgcatgaggaaacgctgcgctccccctcagggagcagtttctgaagccagctgagcacagctggcactggccagagggagccctccaccctcccaccacgtatgcccacctgcaaacctgggttctgagtccccatgcaggggacagacctgaaaattccagtttgtgtcctttcaggtcatcgacaggaatgacagcctggcaagctgcagtgactgcacacagctaccctgtgagctccacttgtgtgggtgcaggtgggcgacaggagtgtgtgacacagacaggcactccaccaggaggaaacccacagcagacgtcaaccatcgctttattaaggctgcgagtcggggggctgagtcatgcactccacagacacccccactgctcccaaggtccacttttggatgaccctgaaggcagagactcctgagatctgggccacaatctagggtgagccacccacagtgccctgctggacaggggggtatgcggactgcacgggggggccctcagcaggggtcttcctgcctagggtggggctggctccagtgggtcctgggctcaggcagggggggtggcagggaggcagggacatccccccgccctctggcctatggctttgttgccctattgccaccagcgcagaagcaatgtgctataccgtgaggtgatgaagaagagccccgggagggagcaggcagctctgtgcctggggcctggccagacctcaggggtgctgtggccctgctcctgttccccctcagctcctcccagcaatgggtctcctccagtggaggtcagtcactcagaagtggacccgcagcacgtcttggctagcaaccggccgctggcaggctgtgcacgtcatgggcagggagcgttgcttctcacccaggcagggtcggcacaggaggtggccgcagggcagctggtacaccggctcctttttgaagtagggagaaaatactcttttgcaggaggcacattcggggcccaggatgctcccaggctgctctggtaaatcaggaaggaaaacaggccagggttaggaaagctgctccatggtccaggctgctctgaggggcagagccttcccaccgtgctgctgcagcatctggcttcatccctcccgagtccatcccagtctgatcaggtaggggagtggaagcgggagagggagcctgggaacccgggaggcctcttctctatcatctttgaccaaatctcagtgcctctacgaatgcttgagaagagctggcttctgagggcagcaggcaggactgggcccttcctcctggtctcccagcaaggtttactttcccctgcgataggtggccaaggctggagcaaggcacagctcactctgacaag

SEQ ID NO: 81 - DNA, 1701 bp, Artificial Sequence
  sequence of T13R
gaatctgaccactcagtcccacatcccaggattcagagaaaaagaattccagtgagggctctggaccccacacagctaaggcttccagggtttaggcaagccctgagggacacccatcataattacccagacgggggcccagcatcccgccccagcattctgccttgcaaggagctccctcaccagggctcagggaagggacagcctgcagttccagcaagggaggcctgcagagtcagccacaggtggccactatcggttgcttggtgccaacttagtgtgagggggcagggcccagactcgagggtgccattaccgtcccccatcgtgtacttcttttcctcgtagcttgagtctgtgtattccaggagcaggcggatggaatgggccagctgggagagatggcccacagctcgggtcagagatggagggtccctgactttgtgacgactctgcacaaggggagccccatctcctcctctcgttcctgcctcacccgcccccaccccgcacgcccagccacacgcacagacagcggcaagcacagaccccgctgtcagggacagccctgaagaggaaccgtccctagagcccgtcctgcagctgctccacacttccccgcccccacgcacccccgtcccaccgcccagcggaccctggctcaccccgcggatgttccagtaccccagtgtcatgggcatggtgctggttgctgtggattctgcagacaggcctcagcggggcggggctcagcgtttgtgagaggcccagagagggtagaggggaagccttgctgcgaccccgccccacggcccgccctgcccccgaaacgggccaatctggaggcctggagcgcgctcatggggctaggagtaggatctcctcccacctcccagccccgtgggtttcaggagagagatcaggacgcccagaagcccagggcgggggagaactggttgagtccaggggttcaagactgaactgagctatgatcgcgccgctgcactctaggttaggcaagaaagaaaggctctctctaaaacagagagattctgaataaagtaataatagcctaataaagaaaaataacacaaaagaacatttggtgctcagggattcactggataagttttcaaaacttttcaatgtatgatagagattgttataaactgcggacatacgtggcatgacagacctaacgtgggaaggacaacacaggcaaggatgattataactcactgtcacttatcagcctaaatccaaacgtcaggaataccgcctcagagaaaagaaaatgatgtttttgtcataagtggtgctgtgctcctagggagcttgctgggtgggaagagagacagaaaggtggggagcaggggctggtggacttggggagggaggagaaagcccatgtggaaacgttagaatctggggtaatcagaggtctttgtattcattcgttttgtaaatttctcaaactctcatgttaaatcaaaataaaaagttaaaaaaaaaaaactaccaggacagacatacacaaatattattaactgaaataaatgttccatcaaaaaggacttaccttaactacatgagttatattatgatttctattattattattattattattttaatattagtatccatccagcacaccactggtcttcaagtggaggtaactttgcccctcaggggacatgt

SEQ ID NO: 82 - DNA, 1482 bp, Artificial Sequence
  sequence of T14
  misc_feature (132)..(132): the 'n' at position 132 may be any nucleic acid
  misc_feature (198)..(198): the 'n' at position 198 may be any nucleic acid
  misc_feature (207)..(207): the 'n' at position 198 may be any nucleic acid
  misc_feature (222)..(222): the 'n' at position 222 may be any nucleic acid
  misc_feature (264)..(264): the 'n' at position 264 may be any nucleic acid
  misc_feature (334)..(334): the 'n' at position 334 may be any nucleic acid
  misc_feature (858)..(858): the 'n' at position 858 may be any nucleic acid
  misc_feature (965)..(965): the 'n' at position 965 may be any nucleic acid
  misc_feature (978)..(978): the 'n' at position 978 may be any nucleic acid
atcagcccccacatgcccagccctgtgctcagctctgcagcggggcatggtgggcagagacacagaggccaaggccctgcttcggggacggtgggcctgggatgagcatggccttggccttcgccgagagtnctcttgtgaaggaggggtcaggaggggctgctgcagctggggaggagggcgatggcactgtggcangaagtgaantagtgtgggtgcctngcaccccaggcacggccagcctggggtatggacccggggccntctgttctagagcaggaaggtatggtgaggacctcaaaaggacagccactggagagctccaggcagaggnacttgagaggccctggggccatcctgtctcttttctgggtctgtgtgctctgggcctgggcccttcctctgctcccccgggcttggagagggctggccttgcctcgtgcaaaggaccactctagactggtaccaagtctggcccatggcctcctgtgggtgcaggcctgtgcgggtgacctgagagccagggctggcaggtcagagtcaggagagggatggcagtggatgccctgtgcaggatctgcctaatcatggtgaggctggaggaatccaaagtgggcatgcactctgcactcatttctttattcatgtgtgcccatcccaacaagcagggagcctggccaggagggcccctgggagaaggcactgatgggctgtgttccatttaggaaggatggacggttgtgagacgggtaagtcagaacgggctgcccacctcggccgagagggccccgtggtgggttggcaccatctgggcctggagagctgctcaggaggctctctagggctgggtgaccaggnctggggtacagtagccatgggagcaggtgcttacctggggctgtccctgagcaggggctgcattgggtgctctgtgagcacacacttctctattcacctgagtcccnctgagtgatgagnacacccttgttttgcagatgaatctgagcatggagatgttaagtggcttgcctgagccacacagcagatggatggtgtagctgggacctgagggcaggcagtcccagcccgaggacttcccaaggttgtggcaaactctgacagcatgaccccagggaacacccatctcagctctggtcagacactgcggagttgtgttgtaacccacacagctggagacagccaccctagccccacccttatcctctcccaaaggaacctgccctttcccttcattttcctcttactgcattgagggaccacacagtgtggcagaaggaacatgggttcaggacccagatggacttgcttcacagtgcagccctcctgtcctcttgcagagtgcgtcttccactgtgaagttgggacagtcacaccaactcaatactgctgggcccgtcacacggtgggcaggcaacggatggcagtcactggctgtgggtctgcagaggtgggatccaagct

SEQ ID NO: 83 - DNA, 1680 bp, Artificial Sequence
  sequence of T17
ggcgccactacgggattaagcctgaaacccgagcggccccggcccccgccacggccgcctccaccacctcctcctcctccacttccttatcctcctcctccaaacggactgagtgctccgtggcccgggagtcccaggggagcagcggccccgagttctcgtgcaactcgttcctgcaggagaaggcggcagcggcgacggggggaaccgggcctggggcagggatcggggccgcgactgggacgggcggctcgtcggagccctcagcttgcagcgaccacccgatcccaggctgttcgctgaaggaggaggagaagcagcattcgcagccgcagcagcagcaacttgacccaagtaagtgcaaaagaaattgccccctgatttattgctgaaacctgtaaggctcgaatgtgcaaaactgatagttttactaacctataaaaacgtctagacgcctacccaagcctaggcgaacaacatgcatccataaaaagagcttcccataaccacctaccctgggcgctcagttagtacggtaaacagagcgcgagcattaaggctttttatgataattccccacaagttgtgaaaagcgaccatccttggtgaaattaatttaacgacctctcttccccaccctgtggtctctccctgcctcccctcctctcctctctccccgtctccaaacctccctctttgtagacaaccccgccgcgaactggatccacgctcgctccacccggaaaaagcgctgtccctacaccaaataccagacgcttgagctggagaaagaattcctcttcaacatgtacctcacccgggaccggcgctacgaggtggccaggattctcaacctaacagagagacaggtcaaaatctggtttcagaaccgtaggatgaaaatgaaaaagatgagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttctttttttttttctttttagatagaagtgactgtgtggttggtctctgaggtatttgggggactctgtatttgctcgtttacgtgttggaaaaaccaagtggctttggggtttcgccctatcccactccctctctttcctgctccattggttccttaagaaatgctatattttgtgagtgcaagctggcttggggagccctctcttgtgtaaatgtcccccatgtttctgaaaagtgctgtagtttagtcccctcacccccagcactgcccaaacaggggccaagtgcgccccaattccaagaatgaaggcagagcgacaacagtgcggacaccccggctgctagcccacggtgaagcccggcggggttgcccaccagttgcgaaagccccctttcctcagggagcacgcgggacctcggtggagatctccagtgaggcttagaggagcccagggcctcgggcgggttggggtttgtcctcagtgcattggacgcgctgctctctcccctgaaggctgggctcgcgtgggcggccgcgggtggtggccctcccggttcctgcccgaggaccagttgtaaatgttactgcttcctactaataaatgctgacctgatca

SEQ ID NO: 84 - DNA, 919 bp, Artificial Sequence
  sequence of T18
gatcatctactaggttgaaaggagagaatatgacttccagaacagcactgatgcttaaaaaggatgcctctggaagaaaaggaggaagaggagcaagtgatgggagaatacagtgggactttgggcaccatagggtcatcctgagtttttcaccaaaatcaggaacagcggcaaaactggtttcactgaagaagacacacgtttggagacatgtgtagtctccaaggattctcacttaacaaagcctatttctgttgttaaaaacccctgcataatgcacccacacacaaacacaaggcttggtctgtgttcctggccacctaaagaaactgattcccagtaagtttaaacctgaatgaaatgtttctgcaaattcagcctcaaaattcctcctctacctggcatccctggcttgtaaactatgtgtctcattagttcataaacaaagcagccctgactttgccttgtactcaaccacagccctaggagccagtagaatttgtccagaggtgctgggctttggagcccaagtggacaaagtcagaccccctttcctcagggcaaagccctcccacagggctgggaccccaaaggctatgctggaagcaggttcagcagcaggatatcaaggggcaaagctcctaattcaaaatcttcctggcttctgaacaaccattaggatggacagagaaaacttttgccctgctctgagagggtcccacagggcttttggaagcagagccaccattgagaaatccctttcaacctgagtagtaattcagatttttctcccactcctgcacaacttaatttgctgaatggaaaattcagccagaagtgatgggctgcttgaaatcaacaaaacttgacacattcttcccattttcattttactttattgttaaacacataattgatc

SEQ ID NO: 85 - DNA, 1174 bp, Artificial Sequence
  sequence of STAR A1
gatcaatagaagaatggagtttgtgtttgctagccatagttttgacgtgtgggagagttggagtctagaaggttctctggacgaatgtcggcttgttaactgcaggaattcctctgtaagtctctgtccttacagaaaatggcccgaaattgaaaaaccctacttcttggaaaacagaaataatttgtgtaatgaatgttgcaggcggtgttggacgttcgtgtggagatattggcaatggtaggagacgatggtatcacacgttggatcgattaaaaagaaaaacagagtctctccatttgtgagtttctctcttttaattacttttgttactttaacatccttaggattcacagacgaaaaacagagacacccaatttttgtgtttcgagactgtgtcgtgtgttgtgtagttggtatcaaccaacttatatctgtaatcattgtttctttttatttattctcggtttgcagaaacatccgatgagcttgtcttagagggacgtttgttgttgttttctgggtctggtcgtgatgaactcgaaagcattgtgtgtttggttagtagtttgaaataggtgtgtgtattgtatttgtatatgctgcgtttgtgttttagagatcatcgtacataaaacacatcatcgtacataactaaaatttgagctaaactacaaaagaaagtaaccttcatttttagtcgaaccaggccccagctaggcagctatctcgtaaataagattgctggcttacgatcgtattccacgtggcaatttatgtgccgtggatttaaatttgtacgtggcatgagtgttaggagaatgtccacatggcttgtagttgttagtcccacgctctgaaccagagcaaccggctccttacacgtgttcggcttaaatccatttttcgaatgagattacacttctaaccttgtctccctctcccgcttataccaccaccactctcacacaagtctctcaagtcacaaactctgtttcaaaccaaaagggaactttgtgtgtgttgtcgagttttatggtgactgtaaaccctagccaagctcattgtttgcctatgaaaatgagtctaccgggtttcaatactcttccccacacggcaacaacgataccggtttccatacggagcaataggacgatgtcgttttttgaggatc

SEQ ID NO: 86 - DNA, 910 bp, Artificial Sequence
  sequence of STAR A2
gatcaaaattttggtttcttcgctttgattttcttcttcttcttcttcttcttccctcaagttccttagaatatctttctcatccattttttttggttcttgttttgttaagtgaacattttagttgattttaaagtgctaaacttaaatgcagcattttactaatataaaattacgctccattattgaccttatatacatagaacaaaataatgttataatcttcgacttttttctaacaaatattaaccaatcatgtcactaagaaattaaaaaatactagtatataggaatctagtccattgtatatatcgtaaacatggacacttcaccaacgaacatgcatggggtctttttataaggttctttataccgaaaccattgttttggtttttatgataattgagttagttttgtggcttttccgttcaactaaaagtctcattatgtcaactgctattaaaccggcgcacatggcatgttttatgaaattaaggtcaattggactccaacttttcaattattaaaaaaaaagaaaaatgattgttgtatgccttggcgaagaagaaaagccgctagctttattcattatcaaacgaaacaaaaacaacaacacatcactaagaatcttaaactcttaaccttacatcaaagtaacttttattacattgcatacaagaaaagaacaaaccagcattattaggtttgagattaaacctgttcccacacatatacatagagatatgaactctacaatttcaaaccagagccttgaagtttctcctcaacaatcatgtcgattttgttttccatttcaggagtcatataactcttccaatcaccaacttcccctttacggaaaaaactcttgaaacttactccttccgacaagcttcctgttttgttgatc

SEQ ID NO: 87 - DNA, 906 bp, Artificial Sequence
  sequence of STAR A3
gatcattaatcgcagatttttacaagacagcagcttggagagcaacttacaagtgtgttataaactctgaactcaacttggaagatgttgacgttccaaatgaaattggaagacaaactatcttcccaccaaggacaagaaggccgtctgggaggccaaaaaggctacgtatcaaatccattggcgaatatccggttcgtatttgtaggagtcccattttttcgactttatctttattccgtatttaattttcaattttatgtggtttaacagaaatcaaagagcgtgaaggtgaagattaacaggtgtggcagatgcaaaaagactggacacaacaggacaagctgtagtaatccaatctgaagatgttttaaaatcggctatattgatagaacgatgaccattttattattgtttttgtgtttggaaatggttatttttggataaaatatgttgcattctattttataattttagtttcgacttattacatataaatctagtaaggtaatatattagcaaattacagataatgatgaaaaacatggacaggtataggtggataagatataaataaggtaggactgaattgttacccgttaataatgaaagaatatacgaaatactaaacattaaataaggaagttactaattattggacaacaaaaagtttaattcctttaaaaagaaattggaatacagacagtttcattgacctaattaagtacttctttgaaaaaaatcaaactaggagaatagaagttgtaaataattgaagggaaacgtcgattcggtgaaaaggttttttaattagtatttaaagggaaatatcttctcttatacagaatatcttgccccagaacaaatcgcctcaaatactaaaagtgtgtacatcttctcttgatc

SEQ ID NO: 88 - DNA, 782 bp, Artificial Sequence
  sequence of STAR A4
gatcaaattcatatgcttatttgtgattatactttgctttgattcaggaaatcaaagaagatagctccaccttacagggtgatactacacaatgacaacttcaacaagagggaatatgtggttcaggtgttgatgaaggtaatacccggcatgactgtagacaacgcggttaacattatgcaagaagctcatatcaacggtttggcagttgtgattgtttgtgctcaggctgatgcagagcaacactgtatgcagctgcgcggtaacggccttctcagttctgttgaacctgatggtggaggctgctgaaactaattaaactcagtatagattttcccaccttccaggactctctatttagtcaaaaacatttgttgttttaatgtatataatatcagaaatttggtacaagactgttactatatgcaatgaaccttgcccctacatagatctgttgtgagttttaagtgttttcatttggaacttcagaatgcaaataaacaaaactttattgaagtcaaatggtgttacagatgaatctttctgattctgtaatcactaatgtaaatgtatctaagcaattgtaagggagtgacgtgtttcggtttcatctcgcccaaaaaagcattcaaacccaagaaacctgcagtttcaagacattgatgggataccatatagatgtatcaagcatcaaccggagtaagaagcgactgaatgccgaagataatgaaaagcattccaccggaaagagccacctgcaacaacataagagctatttgatc

SEQ ID NO: 89 - DNA, 1356 bp, Artificial Sequence
  sequence of STAR A5
gatcctgtaaaacataaagttagagataattgtccgatttgtttgcccttttaatttggagagatatgaaccaaaaacatatttcggaatgggtccctttttcatcgtgtgtaacagttttaccaaacagtaatactttgtgaaagttttgattaattaatgcaaaaagattagaaaaaagcgaaactaatttttggattacactagaaaaaggttaaaatcaataaccaaaaaaagaaaaaggttaaagttacaaaacacaccggtttatagagtgaaatgattattgttctgttgaattgacgtgccagcttagcatcaccttactattatcagtcacctatatatcacaattcacaggcttcttgctttctctcattggctcgtcttcttccctttcttctccaatcaccttagcttgctgatcaggtaaactagattggtgtttcgtgttgttttcttctcaacttaggtgtttgatttgagaagtttttctatgtatgttggcatgttgcgttcgtagcattgcatatcaacggataggtttgaataggtagaattaatttgattgatatatgaaagaatgtttgtatatatactctaggtctaggttattgaatattgagaaatttattttgttaggtttagatgaattattcttcgatgagtggttcaaagttcaattggcaagtcttttcaatgattgtagtattttggtgatgataagtaagttgttaatgactctcaagtctgaattcatgttttggttttgtttccttgtaaaaatgtgaacgtttttcttacagaagctttcacaaacaaagtatggttaattgagtgactaatccactaattctcttttgttgttttatatcgtttattaggtaatgttttttttttttgggtgtgtaaaatatgatactgactcaagattttatcatatttctgaatccataagctaaagtacatttgagagaagcaagagagatagaatggggcgtggagttagtgcaggtggaggacaaagttctttgggatatctttttgggagcggagaggctccaaagctagcagccgttaacaaaactccagctgaaactgagtcttctgctcatgctccacctactcaagctgctgctgcaaacgctgttgatagcatcaaacaagttcctgctggtctcaatagcaactctgcaaacaattacatgcgtgcagaaggacaaaacacaggcaatttcatcacggtatgtctttaattctttcgctgaatcgagtcctgtgtgctggttatcggatagcaaaaacatctgtatctttacttttcttagattagttgtctgaaaatgaaagaagatc

SEQ ID NO: 90 - DNA, 1452 bp, Artificial Sequence
  sequence of STAR A6
gatcgactggtacaatgctagaagccctagaggttgtaggtgatagccacgatacatccttaggtgatgtaagtcaactgaatataaatggccatttacgtagacttcatgtcctagatgatccctcctattataacgtgaatctcggtttcttggtgtggaaaacgaaatgattgatatgtttttgtcagggatttgaggtggtgaacagtcgttatatgactagttatgatgatgaagatacaccgccaggaagtggattcaggacaaaactaagagagttccataagaggtaaatgacgcattaactcatgcctctcaacattttgtcggcattcaaacagatgcattcaagtctcttttaataaacacaagaatcccatttgtttattgttttgtttgtatgcagtgcggcatcattcacagaactagataggaattacctaacaccgttcttcacaagtaacaacggagattatgatgatgagggtaacatggagcaacaccatggtaacaacataattctctgatctcttgtttcactattatttttgttgttattccgcacccaaaaccatgaaatttacaattggggttattgcagaagaacgaatcccatttactagaagaggaaatctaaataaccgcggctaagtttccgagatgagaaatctaatagtgttttttcagcggcatatatatgtacataaaacaaactggatgtatgggaggaggtagtgacaaaggatttgttctaagctaggtttctctataatatggtactgtgttgttggtgtaaacctgaatggatattgttaggttgaaactaattacattcacacaaagaaagaaaaaaacttgaagaaggccatggctggtttatactgaaccacgaattttgttagttttaaactcttagggaaaatgctataatgccttttttgtcttgtagtcgtgtttggtttgaattaaaaaaaaaatagagaacgtcacggcacgccaaaagtgtggaccttgtttattcgccggaagtaagtaaccaaaaacgcttctaatctttcgtttacaacaaatatctctctctctctcgctctctctcgctctctctttcttcttcttcatcttctttcatggctgttactggctgggcaatcacaatctgaattctttcttcctccttgtctctctgattttcgccgagttttgggggctcttgttgttacacgatgagtctggtggttggtcagtctctgggtttaactctagtcggtgatggtctttcgttacgcaattccaaaataaatgtcggaaaatcaaagtttttctcggtaaatcggaggagattggcgcgtgcggccctggtacaagctaggcctaaggaagacggagcggcggcaagtccttccccatcgtcgagaccggcgtcagttgtgcagtaccgacgagctgatc

SEQ ID NO: 91 - DNA, 1085 bp, Artificial Sequence
  sequence of STAR A7
gatctatcttatattgttagttcatgtttgtttttaaagactgtttttatgtttcaatggtatattactgactggggcagtaatattgttgaagtctgtagattatggtcgcatggctgaaatactggtgcagagggctgcttctcctgatgaattcactcgattaacagccatcacgtgggtaagcagaataaaccatgcttctgcttggcgtcttccagttatatagattggtactattttgacttctcgggagattcatatactaagaatatctgctttttattaaatgttgtagataaacgagttcgtaaaacttgggggagaccagctcgtgcgttattatgctgacattcttggggctatcttgccttgcatatctgacaaagaagagaaaatcagggtggtaagtttgcttctcctcctcagtgatggaaactgtaggttttgtatgcatctttttactttctttgttttttgatttttatttgcataaggttgctcgtgaaaccaatgaagaacttcgttcaatccatgttgaaccctcagatggttttgatgttggcgcaattctctctgttgcaaggaggttagtttttctctattgttgtttttatatccgtttgaatattattaaatcgcgcctgtttatttgtgagtttttgcattgagcaggcagctatcaagtgagtttgaggctactcggattgaagcattgaattggatatcaacacttttaaacaagcatcgtactgaggtgaagaaactggtttttgcttgggcatcattcttttctagttagcctttttgtttatcgcgttatagctaaattggtaatgctgcaacaggtcttgtgcttcctgaatgacatatttgacacccttctaaaagcactatctgattcttctgatgacgtaagttctatctccctgactgttcgtttgattggttggtgaactttataatataaaggtttggttttgtctagtaataaacttatttgatatttgaactatctggacttggaaatatactttaggtggtgctcttggttctggaggttcatgctggtgtagcaaaagatc

SEQ ID NO: 92 - DNA, 696 bp, Artificial Sequence
  sequence of STAR A8
gatcatctttttctaggtagggaattgcttatctcggtaagctaagaatgttagaaacaaagaactaggacagaacgggaaatggagaaggaggttagaatcaaagaacagtaaatggagaaggaggttaatgtgtatttcattctatctacattttaactaattgagtgtatccagtcttatccattaatgtaattacaagaagaatagtaccaagcatgtaggttatagttttcactttactgggtgaaggtttctgtagttcaagtgggtcaaaagtggtttgcggaaacatatctctaataatttgattgagaggctcctcgcactcacatggacttaaacttttgtgtattatacaaacatgattcacatacacatctcgtgtatattgcaatacatttggtaaattatctgaaaataataatgaaggtttcttcaaaagaggtccaggagctatttccattaacactgttatactgaacagtatacaaaagaagactgcagtgcgagaatttatggaggatgataatgcatttgagatattcttctgaacactttcatatcttttatgtaaaacatttttgatgagaaaatcaccagtagtatccaaacactttaatccagatgatgggaaaatgctttgtttaaacctactacgaagtatgcttaatacttcattattaccagttgatc

SEQ ID NO: 93 - DNA, 925 bp, Artificial Sequence
  sequence of STAR A9
gatctggtttcggtaattgttgtttccgggaattgagtatagaaacacaaatacatatttaaccctgatgaaagagggtgtaaacttgtgcagatagatgcgaaaacaacgcacgacaaacttgtgaagttggtgctcgatgataaagttagacgaaatgttgtatctcttattgttttgcgacaaatttacatgtcacggctgagttatatgcttaagggaagatgaaaagttcagtcaatttacatgtcaccactgagttatacgttccaggaaagacgaaaggttcgatagaattacattacggttgagttatatgcttaagggagaacgaaacgttcagtcaatttacatgtcacggctgagttatatgttccagggaagacgaaaggttcggtaaaattacattacggatgagttatatgtttaagggaagacatctataaatttacatgtcacggctgagttatatgttcaagggcaaacgaaagatgagtgtaaattatatgttacggctgagttatatgcttcaaggaagacgaaaggttcggtaaattacatgtcacggctgagttatcattcagggaagacgaaaggttgtgtaaattatatgttacggctgaggtacatcacgttaaggctgagttataatacagatcggaaaacaacatttttctggggaagacaatatgaaatttattggccaaagaacaacaatcaaattaagaaacgtaagaatatgtttgagggatacataggaggaagacgaaactatatgaatcaaaacattgatagaagtagaaatatctctaaatagatcgattgagaggaaaactaaacgagagacatataaaatcaaagtaaaagagtagttattcttgattcaactcaaacctgtaacaaatcatataaaattctatagatc

SEQ ID NO: 94 - DNA, 1753 bp, Artificial Sequence
  sequence of STAR A10
gatctgaatgagatgtgttggcgaacgcatatagtttttgtttcttgctgttcataactttgcttatggaattttatttatgtctttctctatacctctttggaccagtgttccatttgcaatagagagtcactcgtgaaaaaaacaaataatgtgtgtgtatcaattattccctctcggccttatattttgtcttctttttgctaattatatactattgatttagatatttacttatattcatgacgtcttcttcttatattcttatttaatttgaagttagaaaattaacgttacaacttacaactattaaattattgttaattggttttataataagtatcgctcttgtctccattcacttgtcttttattgtccccagtaccaaactaccaaatacaattcatattcactaattaattagtttgatgcaaaggatgatgcaatgttaagaaaattgaaactctaccacattctaaaatgaagcaactctaccatatttaatttctttagacttggaatagtcacaatatgaatgcttaggtagttacggttagttaggagtatcacacagaattgaaaataccaaaccacaattttaatcaggtgattcggtactaatttttattaatgaataaaaacataaccgaaccaactcaaagcagatattaacctgaaaatgaactcaccaaaacaataatagaaagactcaaatcgagccggaaaccagattgagcaacgaactcatgggaatatcatatctatttatgtccagactattaatatacatacctatgacaaaatactatgcatgcaatgcaagactgaagtaaccatatttttttgggtaaaccattgataagctaaacttgaatatccatagtacttcatcgtactatgtatcaatagtatagtaagtttgacacaattacattcagtttgatttttatcatataaacctcccaacaatatttaaaaccgtatctatatataaatttatttgattaaatcagcctagaagtttatagttcagtgcagataaattcaaattttgatatatatcttaattgaattaaccgtcttttggttaaattattgttacaagcttacaaaatccactatacaccaagttggacttagatatcatatatgagattaacagccgattacacttgtacattgacctgacctatacaaacgactacaactttatgtatatatatttctctatttttggaaactcgtttgatttgttttcacatgtcgtgaaatttacagctttgtttcctactctcaaaaatagagcatagagctggctgatcacacttcaaattaaaaccaacaacgtatataaactataacccatgtgaacacaaaaatttagaccttttttcaaaaccattccaatttctaacaaaaacaaaattagaaatcctaaaatctgcaaggtgtatggaaggcaaaaaaggctaacaggattaaaaacagtttacattagttattctctttaaaatagaaagaagattttcgataaaaacgtcgtcgtatcttcgtcgacgtctccgtctttaatgggggagcaaagggcaagcggtgcttcctcctccaccgactcatattcaactccttcgccgtctgcgtcaccgtctccatctccggctccacgtcaacatgtcacgttactcgaaccatctcatcaacacaagaagaaaagcaaaaaagtcttccgagtttttcgttcggttttccgatc

SEQ ID NO: 95 - DNA, 1908 bp, Artificial Sequence
  sequence of STAR A11
gatctcactcaagctcatgctcacgttcaaggactttccaaccgcaaggttatcttcaacttgtactcattaaggcctctcaatattcatgtgttatgttcatgtagatgtccggtccagttcaacaactgtttcattgctttagttgtcacgagaaatatttgtatatattattatggtgtgcaaaacatagtaaaatgttgttcaattggcagatgatgatgatgaaaatggaaagtgaatgggttggagcaaatggagaagcagagaaggcaaagacgaagggtttaggactacatgaagagttaaggactgttccttcgggacctgacccgttgcaccatcatgtgaacccaccaagacagccaagaaacaactttcagctcccttgacctaatctcttgttgctttaaattatttcatattgtaaattactttctgctttatcggttttaccatttcgggagtcttttttgtgtgcaatctgtttcgtttggtaagcttgtagtttcatgaaagtgaatgtaagatatgcattacgtttgttgctgaagtgaatgtaagatacgcactattatatctcatgattttctaagaaaaccctcttaaaacgaagatgtctatagcattacgtttctatttccatataatacgttaaaatttatggtttttacgtataaaatgcaaaataaagacacaagtatatctccaaagcaatgtaccgttgggaaaatttattagtacgttttcaattgtcaatgcaaataattaatggatgtgatagtcacaattaaacatacaataataaaaatgatgatgatgattcgatgatgtggtgggaaggataaattaaaccgactttggggcagtgacaggcagtgtcagtgtcaaagacaaccatttgtagtcactatttctatcgaaggttgcaaattgaatggtggaggagtatcaaaacgacacacatacttgaaaagatattttaataatataaaaaaattggtgatggcgtaataacaaacctagagctaattattatccttaatgataccaaatctatatgatacgatatttgttttaaaaagagtaaagactgacacttgagatgtgacactggcgatttcgctcacgtcaccacttttcccacctcaaataacgcttacggctttatccattaattctaagtataattttaagtgtattttttcttgccaaattcaaatatatcttactaaatggatgaacattataaaattgttatcaaaaccattaaatgttcttataatttctttcgttcctccaatgtcatcccaagactttttgacctaatatatgatatatctaacttgctttggaatcgtatgacatatatcttcaaatacatatttcgtatttttttttcacgaaaactaatttagaaagtagaaaaccagctattttaaagaaaataaagtgtgtttatatatattctaaaacaatgctataagaacataagaccaagatatatacaatgttattttatatttattattaagcattaacattgaaattaaaaatattaaacatgtataccaaagtaatcaacattgtagttattactactctctctgttcatttttgtttgattgtttagaaaaaacacacatattaagaaaacatattaaatattgattataaatgtattatttttaatgttttacagttttctataactttaaaccaatgataattaactatttttttaaaaaattaccattcacctatactaaccaataaagattacatagaaaactaaaaaaattaatcttttaaaaacaaattttttttctaaacaatcaaacaaaaaggaacagagggggaatattattttaatttaatttagattaccattgtagttagtaattgatc

SEQ ID NO: 96 - DNA, 1403 bp, Artificial Sequence
  sequence of STAR A12
gatctattgctgtttatggcaggctgtcatttcagaaaagaatggtggtttgggatgtaatgttggtgaagatggtggtcttgctccagatatctcgaggtacatatatttttcctctctgatgctaatctgcttgcatctgtagattgtcgaaactgagaaaaccatgttatggtttgatggcttagtgcctaatatgtgtaattgcaactgtatgcagcctcaaggaaggtttggagcttgtaaaagaagctatcaaccgaacagggtacaatgataagataaagatagccattgatattgccgccactaatttttgtttaggtaattttctgcttcctggctaactgattttttgcggcttcttgtagtcatggatagtcttggtttggttctcggcattgtcattcacaattggctagtgagacgaataagatgttaaatcatcaaatgtgtagcctatcaatatcttgctcttgcaagtttcaactatgttatacgtttttgtgtattatttcttaccttgtggaactgttctttcctgaacaggtaccaagtatgatttagatatcaagtctccaaataaatctgggcaaaatttcaagtcagcggaagatatgatagatatgtacaaagaaatttgtaatggtatgtctggctcgtctgaacaatattttttgtgtctatcttagtactcttgcagtattgtaacgaccagattctctgtttggtctccttgtgggtttagattatccaattgtgtctatagaagacccttttgacaaggaggactgggaacacaccaagtatttttcgagtcttggaatatgtcaggtccaactcggttcccctactattaacggttcacatagattttgtgttctttcagatcacactgtcttctgattcttttctcagagtcaaatatctaaagagagagacccttaaatcttcttgtacaatcattttccttgtctaaattctcagtgttaaactcttgtaggtggtaggtgacgatttgttgatgtcaaattcaaaacgagttgagcgtgccatacaggagtcttcttgtaatgctcttcttctcaaggtatttcgtccgtcctattttgtttattactatgtattacctgtgcacatattgtatgtttactgcctaagaacgacaaagacataatgtgcatacggtgatacaggtgaatcagattggtacagtaacagaagccattgaagtagtgaaaatggcaagggatgcccagtggggtgtggtgacatctcatagatgtggagaaacagaggactctttcatctctgacttatctgtgggtctcgcaacaggtgtgattaaagctggtgctccttgcagaggagaacgtactatgaagtataaccaggtctggatc

SEQ ID NO: 97 - DNA, 1140 bp, Artificial Sequence
  sequence of STAR A13
gatccatttcatatacatattaccaattttggcttttataggtttgtatccagaaggccttttcgtggctacgattaaggaaaatacgaaaacaaaagtgaattttactacttttgtagcatggtttattctactttatatacctaagaaatatgagcaacaattacttctgtaatgactttttactacttcgtagttggtacaaactacaaaagattgtgttgtttttacatgatactttataatatctatattaatatatttagtcgtgtttaatcaaaaaagcaccagtggtctagtggtagaatagtaccctgccacggtacagacccgggttcgattcccggctggtgcattgagctatgatgatataggcttcagcattggttgggtccattgcattcttctgaactatcagttgatgtatgccacacctctgagctcttctttttttttcctcgtcaattaattttttaaagttttgtctgcctaaaaactttcttctttttgattaatcatattaagcatctcggctataaaaaccacggtctactaacttaacatgcattggactagttttagtggagagtgttcgagttaaaatgagaagctcacgattgcataacggaacatttgattcgctaggcatctccatttgtaaaagtagccactccaatacaaaatggtcgatgatggtgagtgggtgagacaaacccaccaccacctcaagaagatatatttctctggttaagaatttgaatggttgacaaagaaacggtcactctatatacttagaaaatatagtcatacatagacaccatcggtctagttataataataaccactggattaatgcccagtgaaaataattgagtagccaaaacatgaatataacaatatcccaatttacatacaacaacacaaaggaggttttacacgattctatagtacaaactcataacaacaaaaaatcacacttttgtttaacagttgcctttatggctttactacagtatcttgtccagggttttcacacataacaatcacagtaaatcgtttccttttctttgcatcttccattccttttgtacacgtaacatctccggcttcccgaccatcagctaagaaccagatgcgatc

SEQ ID NO: 98 - DNA, 2125 bp, Artificial Sequence
  sequence of STAR A14
gatccagcaactaagtcttatgctcaagtgtttgctccccaccatggatgggctatacggaaagctgtttctcttgggatgtatgctcttcccacaagggctcacctacttaatatgctcaaagaggatggtgagttcatcaactagttaatatgctcaaagtggatggtgtgtttgataaactagtagtttaagtagtcagattagtttcaaggtcttcacaggattaggtagatatcacggcaatatttggcctgtataagtcctggtatcataagagagaactctttgagattcacattggttttaagttcatttggcagtaggatattagattttgaattttccaatactatctctgtttgagatttcataaatcgagtttcttcttcattatgttcgctgacgatattgtttttttcatttatttatgaatgttgttacagaggcggcggctaagatacatatgcaaagctatgtcaattcatcggcaccattaatcacgtatcttgataatctattcctctccaagcaactcggtattgattggtgaagagcctgaaaaaaaggcataactattgttactctttagacaaaataacctatgttctcacatcaagctatgtaatgtcataacaacagcgacgaaatacattggaataaattgagtatgtccttaatctgtcgttttatctcttcttttaataaacacagtttatctcatagtaagcagaagaagctttacacgggttgtaggaacgtattaaacggtttgtttcaatttcactctctttggttttgaaattctagtataaaccaaagtagttggtgcttcaagttgtgttacttattcaacaaaaaaatatattatttttaatttttaattttcgtaggtaagattacatagtaacaaaatgttaaatttaacaatgtaagattactatgtaaatgcatgggcaccagtaatcacgtatcttgatgatatatatccctaatccaagcgagtcggcatttattggtgaagaatctcaagactcatagtcatcgctagttaacaatctttttcggacaaaagcgtcttcgttaaaattcggcattattaacctttttgcccttttaaaatcagaaaatttctgttttactggtatttttctttgacgattcaattttttagttgtattatatatatgaaagaagcttaactctctctcacagcttgatatgtcagtatctaaaacaagcaatacataatttaattaatttatcataaaatatttatgattaaaaagtaaagaagataaatattaaaaagctaaatgtctcttataatttaaaaataaaaattaaaaaggattgaaaagtaaagaagataaatataaagaaactattagtatcttataaataaataaataaactaaaaattgaaatataattattttagttttgaattaagaaaatattaaatataaaaaaaattaaacataaagaaactatatatatcttgtaattaaaaaattaaaaaaaaatgaaaaatgagaaaaaaaatataaactcttcatcatataattaatgaaatttaaaaacttattgcttttaattttttgtacaataattaaggaaatttagaaattaattattaattttagaagaaaaatgttaaaatagtttaatagttttgattcactaaatacatgtgtacatatatgatggtatgaggatcaagaaagtgccgtaaaatgtaaaacttccaatgttccttagtgaaaaatgttaacttttctgttgacaagacgtgtatataaacatcacctataccggagaagaagaagacacaaaacaaagttaaaaagaagaaatttttggtgcagtgaattcgaagagcaatatgaagaatattggttacattattatagccaccttgcttgttggtctcctcctcatcatggctctagtggcgagtttctattgggccaaacgacatgtcaaatgttgtggcggagagggactgtcgtcaaaggatgtgttcaatttacttatacaattggttgcttttattctgctttgtggtttatttgcttatttggtatttttggtttagattagtaacctaaagccatagcagatc

SEQ ID NO: 99 - DNA, 1196 bp, Artificial Sequence
  sequence of STAR A15
gatcagcaattacagttggatggaaaaagagagacgagaatgtatctgctgctggtgactttaaggtaggctgagtaccaaattgcattctgactgttcttacctcgaccacctttcttactttccctagctctaatcttgctattactagattgaatctggtggactcggagcatcagctcgttatactcgtaaactttcatccaaatctcatggtcgcattgtgggtagaatcggaaggtatgttttattgacaatcccgagcaacctaatgtatgatgtgcgagaggatagaaatcattttttaagttgtctttacatgtgtggcgcaatcattgttctcattttactttggaattttttttttaacttattcagcaatgctcttgagattgagctcggtggtggaaggcaaatttctgagttcagtacagtaagaatgatgtatacagtaggactcaaggtaaactactctttaaaactttcggagccatcttagccattatgcaatctgcttatttccggtactcttatactttgtttgtagggtattttctggaaagtagagctacaccgtggtagccaaaagctgattgttcccgtgagtgttactttcttcctttcttttcttgtggtgtcatgtctgctgtcttcggataagaaccgaacagattgtgtcttaatctgtggagtagaatatattaaaaaagcataaaccaatagaaccaaagaccaatcctaaaagcctagggatggattctagagcattatccttgactctctgaaacctttacccaactcaattatggacaaagacaaacatccgtattactctggggaagtctttcacttttgacaccttcatgatgattatctttgaaacgtgcagattctactctccgcacatttagctccagtatttgcaactggagcattcattgttccaacatctctttactttttgttaaaggtgagtgattggaccctctaaatataatctacttttggtctattgttataagctgtttaccttattaaacattttcactgttccacgcagaaatttgtggtgaagccatatttgcttaaaagagaaaaacaaaaggccttggagaatatggagaaaacttggggccaggtgattgttacttccgagtttggtagccaagcgagattccttgtaattgtagatgatc

SEQ ID NO: 100 - DNA, 692 bp, Artificial Sequence
  sequence of STAR A16
gatcgctttcagtctatcatgttttgagccttattttgggagcgatgtattaatattttgcctgttctttattttttgtgttgcagacatacaatgaagtgcagcggtgttttctgactgttggcttggtttaccctgaggatttgtttacatttcttcttaacgtaaggacatcttttgttttatgattatggctctagttattctttgtatatgtaacgcaaaacggtggcaatacctagcactcatattagactcaagaactattccttgccacacatctgtgtgatatttatatgggctttttatcttacatatttgaaatccctgtcttccttgtatactttcaccagaaatgcaagttgaaagaagaccctttgacgtttggtgctctttgcatcttgaaacatctgcttccgaggtgtattcttttatccttcatcagtataacttatcattcagagttaatttaccatcctaacttaatgatgttgcattgtgttcgaaggttgtttgaagcatggcactcaaaacggcctcttttggtggatactgcaagttctttgttagatgagcaaagtttagctgttcgaaaagccctttcagaggtactgagctggcgtagattttcttatttactactaaaatatgcatgctttagcatagtgcttctactttaatgacagttgatc

SEQ ID NO: 101 - DNA, 1826 bp, Artificial Sequence
  sequence of STAR A17
gatcacgataattttccttaattatctaattctaagatagtctaaccatgaatattcttataatatcttaactgtataggagattctattttcatccctaaattatattcgtaattttattcggatatacttgcttttattttcgtcaacagatatatatatatatatatatatatattatttatttttaattttcattaaaattagtgatttaattctctattatttgtgtactatataaaacaaacaaatgaatcttataatgtttgctttttcgtccataaatatttccgggaaaaatcgttagatataaatcgaacctagtggtgagtgactcacacacatgtgacaattcccaaaataagtcccccacgtacgctatgtctgttttagtgtgcatgtagtaactattatttactgatttagaatataactagcatttggcccctatttagggataacattgttttagattatatctgttacaacttttaactaaaaattttaaaataaagcagacagtattaatatacaacaaatttattatcattgatcgaagaatatacaaagattaagaaaaagatataaagaaggtacaacttttctacccaatgaatcaattgcgataggcaataactaacaaatcaagagtttagaaatataagagagtataagtacgaaaattatgctgggtatatacatgtccgcttatttcatcattagctccaaccaattgtaatgtgttcttcttctcatcatcagtaattcagtttacaaacattcgttgacacccaaagcttggaagtctaaaaaaaaatgtaaaatgtgcacaaataagtaactacatgacgcagacgctgcctttgaaacaatatcaaagatattgcagatataaagaagtaaaataagagatgactttaaaattgaagtatttgtattaatacaaaaatcttgcgtgaaaatacaattgcagtttaatacaaaaaagaaattgcagatataaagaagtaaaataagagatgaaagaagaatagtaaaaagtatgagaattaatttaccatcaaaaaaacacttgagcttcgattaagatattaaactcacccttgttttaaggcaactgttcagatgagaagccaaaatttgtcgttgttccttgagtgtttgtgagacgggagaatcataggcattgattgtattaaagaataatcctatggaaaaatggagatgtatgagagaaatcgaattcagtcaaataaagcagaaacaaagcaaaaaaaaaaaaaaaccatagaaatctagaagaaggatatatgattttcggatctatggaaaatttctatatatataaaacaaaattacaaacagaaatagaagatggtaaattggttcattgagatgaacaaagtacctgatttctgagtaatcgattaatgatgttgagaaacccatttttgagattttacacagtagtcatggagtttttggaagagagaaagtggagatgtggagatcgtggggatgaaagagaaaatcatttgagaaagaaacaaagttaaataaaaacgacacatactatgcgtaaaaatgaaaaaataaaaaatagtactaagctgatgtgtcaatcactgaatgcattagttattggaaaagtgactgctgatttagtatatttagattagagaaaataaatacttgtaatcatttttcttattagcaatgttgaagtgaaaaaaaaaagaagaaaaaagtgtatatttatcatactcatagtgggaaattgataattcaaaattgctgataaacgttatgaaagaaggtggaggatc

SEQ ID NO: 102 - DNA, 1590 bp, Artificial Sequence
  sequence of STAR A18
gatctgttgattggttaaatcgacgatctcaacggcggaggaagtgacgatgaaggcgcggcagagaggacaattagagtgagatttcaaccaagtatcaatacaaggaacgtgaaacgcgtggttgcatttaggtaacaatctcaagctctcgttctcttgaaactcgcttaaacaaacagagcaatctgaagattcaacaaatccatccatctttctgtatttgtaaacagttatcgatttaatcagagattcatcgagtccatcgccaccaccaccaccaatcgtttgattcggattcgtagctccgttgttgttgttgttgttggttccttgccaggtgtaatctgatgagattctgtttatagctgcggcggaggtagaggaggagttgtggcgacggcggtggcagtatttggagatgagagtgtagtagctgacgaggatgaaggcgctagcgaggattccgatgagagcgatgaggagaggagagaaatcagaggaggaagagtcgtcttcgtcgtcgagatagaaggaaggaggaggagggaagatgacgtaacaccattgagggcaatagacactgcatactccttgagaacagtctctgtatgaatcgtatgttgtaccccatggattagggtttcctgttgaacccattatttgattgttggagaaagatagagagagagagcaaggaagaagatggaggtgtcaagtgtctctctcctttttctttgggctctgcttttgtctggtaagtgtctatttttttatttcgagttaattggtattattagaggagataatgaataaatatatatgttcatgaaagcttttgcatgatggtgttaatactaattgaatgatgtttatagtgaatgttctactttatcaaatttttatttctagtatgaataaaggtgtagaatttgctttattcatttttattctttagctttctctttatgcttccattttttttaaagataaattaatacattagtaaaataaatggagttcattttttttttttttgattttattttgagaaatgagaacgtaacataagaagtgttttagtgttgacgaaataaaaagagagagagggtttagtctatttcaaggcataaaaaaatggttggtgaagtgttgacgaaggtggaatactataacatgggccacgtggatgacaaatttactcctcgacgtatctattaaagttgtggtcagaaatacagtacaatttaccgactacctacatggaagaagaatattttcatttcatttcaactacagtagtataacattcacgttatacgatttttcatttttgttttgtaatcaaagtaatgattttccaaaaaaatcattgctatgattcgaatacatacagttttatattagtttacatatttatgacaactataatacaaaattttaatagttgttcaagggacgattgatgtgaactcgccaaccatatgccctacgtacaaaataacatatttacatgtagaagttgaaaataataataataaagtgtgattaaaaacaattatacaaatgctaacaataggctacgagatc

SEQ ID NO: 103 - DNA, 706 bp, Artificial Sequence
  sequence of STAR A19
gatcttgatgtgtgttttgtgtttttgttattgcaggatgtatgtttcatagtgagacagggcttaagagctttgaccatccgactaatatgatgaaggcaatgccgaggattgatagtgaaggtgttctttgtggagctagtttcaaagttgatgcttgttctaagatcaatagtatccctagaagaggaagtgaagctaactgggcgctggctaattctcgttgattttgcttctagtttcgttaactcttgcttctttgttgcgttttctttttatgtactcttgtttatgtaaatatagccttatgaagacgataaagaaataaaattgatttgcttcttcgtgacatagcagtctttacttagacaactgtgtgataaattcgcaatctcactctttgatagataagagggagggaagaaagcagtggtaaagacaaaactgtgttgattttgtgaatttagaagtttacaatagcaaaaaagaaactttggtcgacttttatcattcatcgttccacatgtctgtaaattcatcaggctccaatgggtttgagagttcatgcatctttcttcttgtttttgcctttattttcttagcaaatttcccagctttatttcttttctccaaagctcgaatctaaaaggcaggaaattggaatatatgagaactctgacagataatcatatatagcaatgtgatc

SEQ ID NO: 104 - DNA, 2064 bp, Artificial Sequence
  sequence of STAR A20
atcgtttcaaagcatggtctaatgatgatcctgatctccgactgatccaataacggttaagcaacgctgtttttgatcctccattgttgtttgccatcgatcaacactcagaaataaggtaattaacgcatctcgagactcattgttttaacaatctttgttttgtttcttccaaattattctcgtgaatatccgtaatctctccgtcttttaatgaacaacacatatcatatgcttttgtttgttttgttttgttttttcaacatttcaataattttgtctttttttcttcgatttaatttgtttatttcctgctataataaacgaaaactataattccatgtaatgttcgttgttgttcatagtgatttatcataacgagcaacaacataaaaatcaagagaataagaaattagagttatgctgcttatttgaattagacaaaacctacttttacttgttaaggaaatgaaaagatgttaataaagatgagcacatcgtacgtggcgcacgtggaagcacttctgtacgacggacccagtccaactcgaaccccacacacatagcaaaggttgttaagttggctcgtaggtgaatttaatacctgttatttcctttatagctggctaattacctaaattcgatccataataacacattcctactatgccaacatttaaccctagtcaaactaattaaaacgtttcttactttttggcctattaaaacgtttcattatgttccgcaaatagtatgaaatatataaagattttctaacaaaaaattactaagaacagttagactgattgagattgtttttatttccttttatttaattttcttttattatactctgtttatttgtgtttaataattaggattctatttgtcttgtcttgtttgctatagttggagttttgttcataaagaatggcgtttaatacggctatggcgtctacatctccagcggcggcaaatgacgttttaagagaacatattggcctccgtagatcgttgtccggtcaagatctcgtcttaaaaggcggtggtatacggagatcgagttccgacaatcacttgtgttgtcgctccggtaataataataatcgcattcttgctgtgtctgttcgtccggggatgaaaacgagtcgatctgtgggagtgttctcgtttcagatatcgagttctataatcccaagtccgataaaaacgttgctatttgaaacggacacgtctcaagacgagcaagagagcgatgagattgagattgagacagagccaaatctagatggagccaagaaggcaaattgggtcgagaggctgcttgagataaggagacagtggaagagagagcaaaaaacagagagtggaaacagtgacgttgcagaggaaagtgttgacgttacgtgtggttgtgaagaagaagaaggttgcattgcgaattacggatctgtaaatggtgattggggacgagaatcgttctctagattgcttgtgaaggtttcttggtctgaggctaaaaagctttctcagttagcttatttgtgtaacttggcttacacgatacctgagatcaagggtgaggatttgagaagaaactatgggttaaagtttgtgacatcttcattggaaaagaaagctaaagcagcgatacttagagagaaactagagcaagatccaacacatgtccctgttattacatccccggatttagaatccgagaagcagtctcaacgatcagcttcatcttctgcttctgcttacaagattgctgcttcagctgcgtcttacattcactcttgcaaagagtatgatctttcagaaccaatttataaatcagctgctgctgctcaggctgcagcgtctaccatgaccgcggtggttgctgcgggtgaggaggagaagctagaagcggcaagggagttacagtcgctacaatcatctccttgtgagtggtttgtttgtgatgatccaaacacatacactaggtgctttgtgattcaggtaatatgtgttcaaagttactactttcaagcaaatcctctgtttcctcacatcatgatc

SEQ ID NO: 105 - DNA, 1834 bp, Artificial Sequence
  sequence of STAR A21
gatcttcttctatatataccggtataagtcaactggcggctgaacaaaggtcgtgaggtaacaaaatatgagacaaatctacaggtcagattgggttctgaattctgataaggtcttaaaaaggagctcaccaacccacaaaaccatggattgaacaagtacaggtcattgccttcattttattctttacttttctaaggctcaagcttcctttattgcctttaataacaatatactaatgagtattttgcactcagtaacaaaattcaggagagtaattttttgccctaacatgttacttttatgtgttaagagtttagaattttggatctatgattttagtttttgttagggaatcatattcatataaataaaatattgccattgacttaattgttgttattcacctaatttctctccaaatttggtcatttacctcagttgattctatattatacttgctaagtgttctttgtctaattctctatcattgtttgatttaataataaccaaaccttaagacttggaagcaaagaagagagaaaatcccaattaatttttaataattcaaagagagatattgagtgacttccactaatacaaagaaagcttggtttgtgcaatattttgcggttaagctattaattgctgaggcaacaccttttcacactttgctttccttcttccaagttttcaacttttctttcttactctttctattaatcaaactgcaacacaaaaatcatttggataatacatgtttagaagatgattaagctttagttttatttcaagattatcataattgttatctgttgttacctacattcatataatcttatcaaaaacgataaagacaaaaaggggatacaatataggtttttattataaagaaacaggaaagaaagaaaagggttttcaccaaacgaaattagttcaatcatttaaattatctttatccttatgattagtgtctttatatctgtcatatgctgcttctccttccaacttcctttggattatattctcttctctttattttaatttccatttgtggtagctgttttattttttgtattttcacgccgtgtccctttaaaataatattaactacaccactaatgttggaacatgaaaaacatgaatgaggtaattatgatgatgaaccaaatgttaaggacaagctcggtgtaactaagaagataattagtgaaacagaacaagtcaataacttgtaagcatttcagaattgaaaataaagataagggaggatgaatatgaatttagtaaatgggtaatgaaagtgaaagaagaagagggaagggttggttactgtctcaagggtttgaaatggagacggttgcttgagaatgaggaaaaagagttagtaagtttttaactctctctttctctctccctctctctttttcaacgtcaattcctttaaggaatggcctctctctctctctgaaagtgtgtgtgtatatattaaacgactccatttctcctctgcttagaccaaaactcatcttctatactgcaacaaagaaggaggagccgttgagactacaaaatgactgcagcagaaaacccttttgtatctgacacctcttctctgcaaagccagcttaaaggttcttatttttctttctgtttattgttcatcaacccttatgagtaatttgcttgatgttgaggttgttctgctttcttttaattccactctgcagaaaaagagaaagagcttttggctgctaaagctgaagttgaggctttgagaacaaatgaagagctcaaagacagagtctttaaggaggtaacatgcatgatgatc

SEQ ID NO: 106 - DNA, 751 bp, Artificial Sequence
  sequence of STAR A22
gatccattaagaagcagccgcaaaatcggattgagaacaggaaaagaggcggttaaggcttatgatgaagtcgttgatgggatggttgaaaaccattgtgcccttagctattgttcaactaaggagcactcggagactcgtggtttgcgtgggagtgaagaaacttggttcgatttaagaaagagacgaaggagtaatgaagattctatgtgtcaagaagttgaaatgcagaagacggttactggagaagagacagtatgtgatgtgtttggtttgtttgagtttgaggatttgggaagtgattatttggagacgttattatcttctttttgacagaaatacattgaaaactaccgttgctaatttgataggtatacatatatagacatgtatatattgtataattatatgtcaagattatttatttattttacatttttcacaaaaaaaaacgttaatctatttttctgtcacaagtgtgtttttattcatactacatactacaacgccaatttaacatgccaaatataaaacatacatgggcaaaggcccaacagccagtttaaagaactttgtctgaagagaaagttgttgtatatatcacaagggatatgtggtaattgggaaacatgttgggttgacacgtgggaaattgaaggagatggagtttccgtcactggtagaatcttctaacactagagagcttcaattcaggttgaaatcgtcagaaaactaatgcagacggtagatc

SEQ ID NO: 107 - DNA, 653 bp, Artificial Sequence
  sequence of STAR A23
gatcaaaacttagtcaaatcgttccttccattttctttcagtttgattccactttaatggcgtcataatcatctcttaaatcaaacaatgactccactatctcgtttccgatctcttgttacataaagttttctgtagcattgagattgtccttttcggaattgcttttatttgcgcagcttgatggaaacaacaaacagtgtagtagtttagtagaaagactgagagataaaacgaagagtcaagttcctaagtccattacttgcattaaccgcttagagatatcgcgtatagcaccattacacgcaacgatgaatagcccgaaaggatttggacctcctcctaagaaaaccaagaagtcgaaaaagccaaaacccggaaaccaaagtgatgaagacgacgacgatgaagacgaagatgatgatgatgaagaagatgaacgtgagagaggtgtaattccagagatagtgaccaacagaatgataagcagaatgggatttacagtggggttaccactcttcattggtcttttgttcttcccattcttttactatctcaaagtgggattgaaagttgatgtgcctacatgggttccgtttattgtttcgttcgtcttctttggtacggctttagctggtgtgagctatgggatc

SEQ ID NO: 108 - DNA, 548 bp, Artificial Sequence
  sequence of STAR A24
gatcagactgaactcgtgtactctgagccttgcttcttgtagctcttttagctttcacattttcatcagtattcacatcattcctgataattgtgccagaagtcccacgactatcttgttgctcactaatggttgctgctgcagatgattccatgttgtcctcttgtgaaaccccaatgcttcgtctagcaactgtatttcttgcacttcctgctttgcggtttttacatttggatgatgcaactttaactttaggtagcttcttttgagtaagatcaatctcatctctacctaggacctgcaaatcgatgaaatttgagttcatttcaacacacttgatgacactatcatagaaaacaaaaagaccttgctgtaccagagtgaagaacagcctttaccttggccttcacaggactaggtagaatctccggagaacaaggcctctgagtccattcaaacatttcgctatcaaacatgtcacctggattgggcttttgttgctcgtcttcctgaaacattcatcggaaaaaaagtaagatcaaaggatc

SEQ ID NO: 109 - DNA, 1000 bp, Artificial Sequence
  sequence of STAR A25
gatccaaactctgcaatgtatattacgaagtcgtttgatataacacctctcttgataaaagatgattagaacctaaagtaattttaaaatatggtgaaaaattagactcttggagtatataaatggctcaatctgtattgcccgcaccgcccaaactcccatggcaaatccattgacgaaaccaaggtaaaaatcacatgctttgagcgtttttttaaaacagaagtgtaagcttaaattttttagtttaatagtagtaacaaattcaaccttgtgaagagatttattaataatattaaaatcattcccctaattatttgccttgagtttcgagccttctactgtaccactcacacattaaaaatcatcagactattcaaactttcttacatggttgattagttcatctcatatatgctcagtatcatactcttgcagattaatttttcattttaattatcaacgaattttttatttaattattcatgaccaaaatacatttattttttttaaataaaacaaataataaatttggaagtcaaaaatacaatcaatagaaaaaaaagtatgacagtgatagataatatttgcagaatattatgtgaaagctattttctctgtaacaataaatgagaaaatctttattattttacatgaaagaaaaagaaaacaaaacagagatatttttccagctgaaaagaacaaacatctctcattgatgttcagtgaacttgcaccaaacttcacttcttctatacttcttcatagccacaaactcagttctttgcaagaaacacaaacttaagtattcaaaatatcgtcatcatgttctcaagattccatgctctgtttcttctccttgttctttcagtaagaacatataaatgtgtatcttcatcttcttcttcttcttcttctttctcattctcttcattttcttcttcgtcttcttctcaaactcttgtcttgcctctaaagacccgaataaccccaacggatc

SEQ ID NO: 110 - DNA, 1926 bp, Artificial Sequence
  sequence of STAR A26
gatcctcgattcttatctggatacagaagaaaacacctttttgtcttttaagtactcggagaaatctgagggtatctttttcttgagcagatggaggtgaagtcctgagttggggaggagggggctctggaagacttggccacggtcaccagtccagtctttttggcatcttaagaagtaacaggtttgttttacttaatttcaatatcgttttgtctctttctcatgcattttttgctcacaagaattttcccatttcctcctttactttatcatgattccttcataattttcttgtattgcactgtaaagtatccccctgattgcagtgagtttactccaaggcttatcaaggaacttgaggggatcaaggtaatctagtggtgaagaatatccaccttggatgaagagtttctagttacctagtggtggttttaatctttagactttcatgcttatgtttttccattctttctgtcgagcactaggtcacaaatgttgctgctggtctgctgcattcagcatgcactgatggtattgatttactttcttaaaagtatgaatgttgtgccatttaccgaactttatgaggtttgtttgcaaatgcagagaatggctctgctttcatgttcggagagaaatctataaacaagatggtaagaaaatgtctttttctttgatttctgtggtcatatatgtgaagctatctgatgggaaaatacagggctttggaggagtaagaaatgccacaacaccatcgattatcagtgaagtaccatatgcagaagaagttgcatgtggtggctaccacacatgtgtagttacaagtaatactctcttattatatcgttctttctttgatattgagtttgcttgtatactgcaaatgcctgtcctgctcaaatttctttttgttattctttatagaggcccaaaactgctctttagtttctgctaaatttatgaacatattgtgtttgtaagatggtcgataacaactcatcgtttgatgtttccttcgtttttggaaggaggtggggagctttacacctggggctcaaacgaaaatgggtgccttggaacagagtaagttacataccccgaaaaaatagaatgtttccccataagatgaaaacaaggttcttgaactgtacctatactcttatttcaaaaaattcagttcaacgtatgtctcacactcccctgtgagagttgaaggtcctttcttggagtctactgtatctcaggtatcttgtgggtggaagcacactgcagctatttcaggtagcatctcttttgagtaaaacatatttgtttcctctctcattgtataagttaattcaactcaatttctgaaacttgtttgcagataacaatgtcttcacctggggctggggaggatctcacggcacattctctgttgatggacattcctctggtggacaattggtttgtttcatcatcttatcttattgatcaaatctctgaaacaacattttcaagtgtcgaagagaataaatatggtatgcttaatatgtagggccatggtagtgatgtagactatgcaagaccagcaatggtggacttgggaaagaatgtaagagcagtgcatatatcttgtggcttcaatcatacagcagcagttcttgaacatttttgaagactcggtctcaagttaatatcatatacagatgtttagtttattcttgcttaaacatctatagactaaaaaaataataagaaatttacactattgaatagcgatcaattacaccattggttctaacttgaacaatttagtaaataggtggaatattcttgtcgtgtaaattattgattttatttatttatttttgaaaactacaacaaacgatagaagagttgaggaaatctctttgtaatcataattatgagaaaattaagatc

SEQ ID NO: 111 - DNA, 1109 bp, Artificial Sequence
  sequence of STAR A27
gatcggaatcattttgggagtttgaaggaactaaacataatatgcatgtcgaagtcaacttattgcaaataattttgaaatgattctgaattggaaattcatgaagcttaattattttatctaaataagtttaatataggtttgagtgagatatcgagattaaatgataagagtctttcttcgaggagacattagaattctacacaaaaatcgaaattaatctagtccttgacaatcagttttcaattaatcaaaaacctataaaattcaactcaaaaccaatcgtatgaaacttcattataccatataatctggttacttagcttaaatctctacccggcgatgtttcatgcttgagagactaggtacataggacactaggagtactgcatatatggttacctcatgagttctcatcgtaaaatcatccaataaaaaatggtttcctgcttaggtatacggtataccatcttgtatcgttaaaatttatagctcagttcgttgctaacagtcaaatacgtctttccagggtaaaaaatgtggaaatttgttccactgtaaaaacctaataatttttgacattaataattaaaagggattataatgtaatatatacaaagataggggagacagagacgaaggcccacacatctttaacaaaagaacaacaagcccgtgaccccaaaataaaactagctttcagatttattatttttcatctgacataattgcaaccgttagatttcatttctcaggtcccattctgactcagatccaaccgtccatattcctctagtgtcttcaatagttgggccccttttctttttcctctcgccgtacactctccttccagcgccaacgccaccgcccgagccacttcttccgccggcgccaccgcgatttcctcgccggaatcccctccttcgccgcctttcccgtagaccacggaaaggatgcttatggcgtattctctccctctaccagccaatctcgccatcaccgctaccatcgccggcaccgtcatcgcgtgagcgcgaacctccgccgctccttctgccgttgtacacattagctcaagagcagctaaggctcgctccaccgctgagatc

SEQ ID NO: 112 - DNA, 1659 bp, Artificial Sequence
  sequence of STAR A28
gatcgaactttggtaacatgcttgcttactgctttctattgtctgcaaaacctctgttctgggtgaccttctggcccctctctctcgaagcttcagaactatggaggagagattggataaaggagacaaaaggtgtggtgtggcgaaatgttagggtaccggcaattgtgtatgtatgagttgattttgttcttttctcataaagaggatttaacaaaggatgagaaaacaaatccaacttgagtactacgaggagataaaagcttttattgggtattgagtattgacacgttgttgaaagtctgatacattttagacttttactgcatatgtccaaatatttagatttttttttcgtttctcaaaaaagtaacttgtttaacaaaaaaaaatcgttattgggcttttcgtttcttttatattgggccttgagcctttttagcttttgtatttttagtccttttcgggtttatttatttattaataagataccaaaaacataacaaaaatgtagttttgtatttttaacctagtcttttaaatatttaaacttaattagaaaaattctatttaaaatattataaaaaaaacatgattttgtgattttcccatattttgtgtaactatttttgacaagcttttgaaacaacaaagacaaaatccatgtgataaggtcggtcaaaaatcttgcgtagtagaggagttaaagatttttggatggttacaatggtatactcttatttgatatcccatcaatggtatatagctttgaatggtaggacaagtgagagtaaaattttctcatcattgctaagttttattttaggttctacattgtttcacccttcttaagtatcctactctcaactagaaaaaaaaattgtgagggcggttttatcggctggaatgcagctcatgtagctcccacgacggagttttctggctaagaaactcggacacaacgttggcctccaatatcttcaaggcttcttcattcgtcaccgacctcggtgtcttatactgactcacagaagagcctctagacagaaagaagttcatgagcttgtcgaaagcgccaggcttaacaaccttaatctcaagtggtccaatgttcttatcattctttcgtccttttctgtaaaccgcgtccagagactcctcaatggtgaagcagcattcctccaaaacattctggtcaagctcaagcttggcgtccttgacttttctcccgagttcccagtagagcacgtagtgacctggatacgaggaggaatccacacggctagtgaaatccatgagcattaggtcatgtggctcaagcaggagactcgcgttagtcactgccttgaggaggtcttcgtcgtaggtcttgtccatgtcgatgctcagaacaactttctgtcttcccacgaaatgaaactgtggcgcattgttgtagaaaccagtcactcttaaaacgtcccctaaacggtacctatacaaacctgtataaagaattttgatacacattaagaaaattattaacatgtcatttagttttgaaattgagagagtaaacaagaaaaaacacttaccagcaaacgttgtgacaacaggttcataatcatgaccgattttaacatcgacaagatcgactacaacaggattctctgcgggatc

SEQ ID NO: 113 - DNA, 874 bp, Artificial Sequence
  sequence of STAR A29
gatcagagtcacaaccataggagtcggagacggccatgcatgtgtcttgatagaagaattaaccggttctaaatctgaaaacgaatccggtcgtctcgaaccgaaatcaataaccggtccggtcaaagaaacggttgcacgagtgaaggaaacggttacgaaaacggagccgttaatatgcgatgacggagtgacaaaggggaagctgacgatgtgctacgaggtagacgttgacgttgacggtgggaggtgtgttaacggagatttaacggcagttagctacggaggaggtttgggtaattgtggcggggattggtgggagaaatgggatggagtggtgaggatgagaaatggtgatgacagttggtaccgttacgtggatttaacggtgattaatggaaatgtggtaaggttatgggatgacaacaaaacactagtaacggcggcatgtgtctaaattagagaagtttcatatttcggaaagtttttaaatcttgagaagctttcttggtttgaagtgttttttttttgttggttgattaagttgtaatttgtaaataattttcacacaagagaccaagaaggaacgcttaaatcaatatcaattggtgttgattcccagctttttctagtcgaacttaggtaacacgtccattgcgatgatgaattcgtgacaaggggtcaactatttgaacacaacaaacaagtgcgttttcttgttaaggcccatctaaaattgactacacacatttacttttaggcccattttaaacttgactgtagcctgtaggcatgtatttgttcgtgttactcccagcctcaaacccgcaaaatccacgaattcttcttacttagtctagactctggtctgatc

SEQ ID NO: 114 - DNA, 2138 bp, Artificial Sequence
  sequence of STAR A30
gatctggctaatccgtttagcacacaaccagatgtaacattggttgcaaagattattgaagagtctcgatctaatgtaacacacctctgcgcattcaggagtgcttacgtcaacacattccgggaacgaaaaactgttagcgtatgtgtattttaaagtattaccatatttctttatatcttctagcacctcctcacaaatgtcacgtgcgtcctccgattccaaagcataatggttgcttccgaagagccgaaggtagacaccacccatgtgagcattaccagcacatatgtaaagaattgcgcatgcaagggttgcagcggcgttccttggggcgattcgctctaagtgtaggatagctccctggatgtcagactcatgtgtaacgagacgcagtccttcatggtaaatagccgtggggttaccagcttgtaagcaccgtttgaagaagggtctatagcgaccttcggagttgatgtcatttggatcgtggcctgccgcgtagaagtcatcgggatcgtcgcacatgctgaaaatgtttgcatttttgaggacatccggacagtagacaatgtctcttccacgaggaccggatttcaacataggtccgaggtaccaccaacatttgtcagccattttcttggctatcttcgcaagcaaatcgtcaggaatatttgggtttgtcatatttaggagtaaggtgtttcgagaaaatgaaatttgaacacttaaataagcatcattgaagatatggttgggtaagttatggttgtatttattgcaaaggtattaagtgatgatgtgtattcatattgtcaaatcaaagtaatagtattccatatataatttgttatcgttgttatgagcaacctctttttattaacagcttaaaactagacgtgtacgttttactgacggtcttagtgtacgtccacatttacatttctacatttactcaacaaacagtgtacgttgtagtgtatgttttagtgaacgtccacatttacatttctacatttgcccaacaaacagtgtacgttgtagtgtacgtccacatttacatttctacatttgcccaacaaacagtgtacgttgtagtgtacgtttaagtgtacgtccacatttacatttctacatttgcccaacaaacagtgtacgttgtagtgtacgttttagtgtacgtccatatttacatttctacatttactcaacagacagtgtacgctgtagtgtactattagtgtacgtccattcataaatatcaccatttatgagacaaaccaaagacctcatacgtttgcatgtgttattttttagtgtacgttagagttgatatctcatgctagtgaacgtccatatctagttttccgagacaaagaaaaaacctctaagtattatttggtagatgcacgtgtacggagttgtggacgcttagattttaatatccaaatttacatttactgcagtgtctaaatatcatatgtgaatttggctgaaaaatattcaacttgagaaacataacacaccttgcaaatttcttaagcaataatataatttcaacataaacataaacaacatagtagaaggcttatcataatttgaaacatgacatagcggataacataaacaaacatataaagtagaatggaataactatagcatttgactaacacgcctggcacacgaccagaggtaacagcggttgcaaacgttttggaaagctcctgataccatgtaacaatataaggcgcaaggaggcatactaattccatggctggtaggataagagaacgtaggaccatatgtattgctgtatggagggtcaaacttctttatttcctcgatgaactcatcacccaaaactcgagtggcaaccgagtccaatggataatggttgcgggtgaagagctgtagaaacaagccgcccatataatcatacccagcacatatgaatacaatggcgcatgcaagtgttgcatttgctcgtactggagcatgacgctgtaagagcctgatggctccattgatgtttcgttcatgcgttagaacacgaataccttcgtaatacacggccgtgggattattagctgcaaaacaccttaagaaaaatgttcgatgtcggccttcatcagcggatc

SEQ ID NO: 115 - DNA, 2092 bp, Artificial Sequence
  sequence of STAR A31
gatcaaaagaatcgtacttgaaatatttagtggaacgcatatgtcagagttacagatatggtttaactctttttatctcctttttttaatggtgtttctctttttatctcctataatcttttgggaattttttattattaaatattaattaaaaagataaattcttagagaaaatcccaactgacttgttaactagtgagacatatcttatttattctctgcttatctaaaaagaaaatgaaaaagaaaaaaaaagtatatattagaagattaatataagtttagggggaaaatgattattattactatttataaaattagtatatttcaaaattgtacaattaattactaagccttaaaataaaaatgtaaaagaagattatcatcaagaatagtataccatctttgtttcaaaagaaaagtttactaaaagaaaaaacttttgtttaatttctactaaagctgaaaggaaaatgattgtcaatttgttattattattatttatatgatagatttcttaagaaacgtatagagttagttacaaattctaaattaaaaattgtatgataagattatcttaagaaagttatacaatatattcctaattctaaaagaaaatggttatttttttggaatagatatacacaacaaaacaaatttagtataagaagatatgttagattaactaaataaacatctcaggcatgaaactggattaggttaaccagaggtccagagacctatatatctctaggcattagggtttaactacggagcaaagcctcataatcaagtttatatcttgcgcatctttagcaaccaatcaattatctaagaagccatgactaatactaatgttgctgctacaaagcctctttctactatggtcgatgaatctcctagccttctccgtgattggtggtgagactctagatcaatgatttttcttacttttttcccattactatgttatgttacgtaacataagatggattaaactgaatctgatcctcttaaattatattggttgcagtatgaacaagaacctacaatacaactttgcgatgaacttcgtcatgataatcatcaacattgaagcaatcttgtctatcagaaaccacgaaaatcacgtaaggaaagattattcaacgattttgataatttccggtatgttcttgcctttcgcctattaagttgcgtttgttgggttggcgcaatcagggatgtgacattatgtgaactcgcctacatcttcggacgcatcagtcacaacataggctttattttcttcctagaactcctctattgtatttctccctacttggctctactcgttggtctacatgtaggccaatggtatctaacttccatgattggactgtctctatgggaaggaatgcaagcattacgaactgatatttaacctcgtttaatagtaaaatctaaacttatttagctgcatattttggtttaaggcaatcgagaatgtcttagcatctaaagcttacttcgtgggacgcatctgtcacacgttcggcttttgtattttcgtccacctcctctattcggtttctcctcacttggctctatacttcggtctcccttgtttgctaggtttcgtagccgtcatgattgcaccaagttgtccgtatcaatggaaaggcctatgcaacaaagtgcaagagttacgagactggtggaagcatgtgaatcgaccacaatcctcggttgttattgttcaaggatctccatttctaagatgtgaattttaggactcttttatcccttttgccttttaaattggaataccaacgtttattatgtgggttagttatgtgtgtatatgatatacaaatcaaacaacatatataaggagaagagatattgaatgttgattcttaatttacaggaacatgaagctcgggtctttccggcaatgccatcaatatccgaggcggtgcagtttcttcgtcagacgagaaaccagagagtctagtatcctaattttgaacaaatagagcataaaggaacaagttatatagcttcacataacccgaaacatgttttaagtttcaatatcaaagacaagatc

SEQ ID NO: 116 - DNA, 1290 bp, Artificial Sequence
  sequence of STAR A32
gatctagacatatgtgtgagacgtttcattgtaggtatctgaatgtaaagctcaaagctttaacctttgaaccgataaacctctaaagctctctcttttccttggatgagtctcacaagttaagaacttcagtgaaataatctgactttattgaacccaaacttgggtatcactgtttatcttagcattacagagttttgtttttgttatgtacattggatttgaagtctacaatgtttttccaggtttataaaccggaagaatatagccgggttctagctatctgtggtcctgggaacaatggtggtgatggtttggtggcggcgaggcatttgcaccactttggatataaaccgtttatttgttatcccaaacgtacagccaagccactttatactggactggtcactcaggtttgtgtaaccagtgcttaatttatgggggatctttgttagctttctccgtttctttactgcctgctgaatttgcctgtttttgtagttggattcactctcagtcccttttgtttccgttgaggatctgccggatgacttgtcaaaggactttgatgttattgtagatgcaatgtttgggttttcattccatggtaactatttttgtgcatgaatcgttagaattcttcaaagcatgaaacaattataagaagtaaattcatcaaacttttgaacagcaagttttggaatcaaagtctcagagatgcaccttattcatttgcatcatgtttcagttggcctttgaaaatccattttttgcacatgtaggagctcccaggcctccttttgatgacctcatccggcgattagtatcgttacagaactatgagcagactcttcaaaaacacccagtcattgtctctgtggatattccctctggttggcacgttgaagaaggagaccatgaagatggaggaattaagcctgatatgttggtaagtcttagccgaaatgcttgtgtttctctttttctcttgtactcatttgttactatctgatataatgaaaactactttataaattgaacatatttactctttttaggtatctttgactgccccaaaattatgtgcaaagagattccgtggccctcatcactttttaggtgggagatttgtaccaccttctgttgcagaaaagtataagctggagctccctagttacccagggacatctatgtgtgttagaattggtaaacctcccaaagttgacatatctgctatgagagtgaactatgtctctccagaattgcttgaggagcaggttgaaactgatc

SEQ ID NO: 117 - DNA, 869 bp, Artificial Sequence
  sequence of STAR A33
gatcccgttcatgtatttttgccagttcgagttggggttggttctgtttactttttctagtccatgtattttgcagacctattaaaaccattctgttttttttttggaccaacaaaacccatccgtttttagatacgaaaataaaattttattaaaaccattatttttcttggaccatcaaaacccatccgtttaaagatacgaaatgaaattcgattgataaatacaaaataaagttcaccaaacttaaataaaaaggcatagatgggaccaatgagaaagaaatttcttttctcctcaatttccccaaaaatatataaaccttaagtttacttttttgttgcaaggaaaaacattaatctttttcaactttctaaaaacaatcatttcaaacgttaaaggaacctcctcctttctttacgcgtttgcaatataacccaagaagaccgcttgtttgtacaactttccaaaaaccaaacagtagtgtaataaacctctgacttcttttttcttctctatttttgtgggtgataatcaattcactcggtttgaaatttcgtccacttttcaaagatgagtgaatgaaaaagccacgaaactttccatttcttcctctgtgtataactctcactgagtacgacttgccattttctcatccaaaaaaaatgtttatccaaatacatatttgtgaactttgcttttaaaccactcaagattcttccccatggcttcttcgtcttcttcttctcggtctcgcacctggagataccgcgtcttcacgaacttccatggacctgacgtccgtaaaacattcctcagccatttacgtaaacagtttagctacaacgggatttcgatgtttaatgatc

SEQ ID NO: 118 - DNA, 921 bp, Artificial Sequence
  sequence of STAR A34
gatccatgcttttgagtttaagtgatttatttaagatcctctaaacttttttttcttcacttagtggtggttccagtcaatttagcaagtaagatgttgtatgtgtcaatgctataactgtgaattttcagctattgtagtttgatttttgtctttgttagcttcaggtgtcttgaatctgaatctgtggctatatttggtgctcggtggtgagcaggaagggagggggatattgtcagggttttaatgtacgtcagatgaatagagcaactaatgttactggcagtagaaggagggggtttattctcagcgtccgcgtctgggtatagtaagggattgacccttcttttctctggtgataaagacgtagataggcccatgagagttgtcccgtggaatcactaccaggtggttgaccaagagcctgaggctgaccctgttcttcagctggattctattaagaaccgagtttcccgcggttgcgctgcttccttcagttgttttggtggcgcttccgcgggacttgagaccccttctcctcttaaagttgaacctgtgcagcagcagcatcgtgaaatatcatcaccagagtctgttgttgttgtttctgaaaagggtaaagaccaaataagtgaagctgataatggcagcagcaaagaagctttcaaactctcgttgaggagtagcttgaagaggccctctgttgcggaatcacgctctctagaagatataaaagaatacgagacgttgagtgtggatggtagcgatctcactggtgacatggcaaggcggaaagttcagtggcctgatgcttgtggtagtgaactcactcaagttagagaatttgagccgaggtacgtgtgatatgttttcctcttattgagttgcttaaatcccaatacgagttaatttaagtagatc

SEQ ID NO: 119 - DNA, 1140 bp, Artificial Sequence; identical to SEQ ID NO: 97
  sequence of STAR A35

SEQ ID NO: 120 - DNA, 13 bp, Artificial Sequence
  1oxP sequence
ataacttcgtata

SEQ ID NO: 121 - DNA, 13 bp, Artificial Sequence
  FRT sequence
gaagttcctatac

SEQ ID NO: 122 - DNA, 6 bp, Artificial Sequence
  oligonucleotide
aaaaaa

SEQ ID NO: 123 - DNA, 6 bp, Artificial Sequence
  oligonucleotide
tttttt

SEQ ID NO: 124 - DNA, 6 bp, Artificial Sequence
  hexamer
acgtga

SEQ ID NO: 125 - DNA, 631 bp, Artificial Sequence
  STAR elements in STAR3 forward
  misc_feature (5)..(5): the 'n' at position 5 may be any nucleic acid
  misc_feature (11)..(11): the 'n' at position 11 may be any nucleic acid
  misc_feature (573)..(573): the 'n' at position 573 may be any nucleic acid
  misc_feature (585)..(585): the 'n' at position 585 may be any nucleic acid
  misc_feature (591)..(591): the 'n' at position 591 may be any nucleic acid
  misc_feature (593)..(598): the 'n' at positions 593-598 may be any nucleic acid
  misc_feature (603)..(603): the 'n' at position 603 may be any nucleic acid
  misc_feature (606)..(608): the 'n' at positions 606-608 may be any nucleic acid
  misc_feature (610)..(610): the 'n' at position 610 may be any nucleic acid
  misc_feature (614)..(614): the 'n' at position 614 may be any nucleic acid
  misc_feature (618)..(618): the 'n' at position 618 may be any nucleic acid
  misc_feature (622)..(622): the 'n' at position 622 may be any nucleic acid
  misc_feature (624)..(625): the 'n' at positions 624-625 may be any nucleic acid
  misc_feature (629)..(630): the 'n' at positions 629-630 may be any nucleic acid
acgtnctaagnaaaccattattatcatgacattaacctataaaaataggcgtatcacgaggccctttcgtcttcactcgagcggccagcttggatctcgagtactgaaataggagtaaatctgaagagcaaataagatgagccagaaaaccatgaaaagaacagggactaccagttgattccacaaggacattcccaaggtgagaaggccatatacctccactacctgaaccaattctctgtatgcagatttagcaaggttataaggtagcaaaagattagacccaagaaaatagagaacttccaatccagtaaaaatcatagcaaatttattgatgataacaattgtctccaaaggaaccaggcagagtcgtgctagcagaggaagcacgtgagctgaaaacagccaaatctgctttgttttcatgacacaggagcataaagtacacaccaccaactgacctattaaggctgtggtaaaccgattcatagagagaggttctaaatacattggtccctcataggcaaaccgcagttcactccgaacgtagtccctggaaatttgatgtccagnatagaaaagcanagcagncnnnnnntatanatnnngntganccanatgntnnctgnnc

SEQ ID NO: 126 - DNA, 774 bp, Artificial Sequence
  STAR elements in STAR3 reverse
  misc_feature (637)..(637): the 'n' at position 637 may be any nucleic acid
  misc_feature (671)..(671): the 'n' at position 671 may be any nucleic acid
  misc_feature (716)..(716): the 'n' at position 716 may be any nucleic acid
  misc_feature (728)..(728): the 'n' at position 728 may be any nucleic acid
  misc_feature (731)..(731): the 'n' at position 731 may be any nucleic acid
  misc_feature (741)..(741): the 'n' at position 741 may be any nucleic acid
  misc_feature (752)..(752): the 'n' at position 752 may be any nucleic acid
  misc_feature (756)..(756): the 'n' at position 756 may be any nucleic acid
  misc_feature (762)..(762): the 'n' at position 762 may be any nucleic acid
gagctagcggcgcgccaagcttggatcccgccccgccccctccgccctcgagccccgccccttgccctagaggccctgccgaggggcggggcctgtccctcctcccctttcccccgccccctaccgtcacgctcaggggcagcctgaccccgagcggccccgcggtgaccctcgcgcagaggcctgtgggaggggcgtcgcaagcccctgaatccccccccgtctgttcccccctcccgcccagtctcctccccctgggaacgcgcggggtgggtgacagacctggctgcgcgccaccgccaccgcgcctgccgggggcgctgccgctgcctgagaaactgcggctgccgcctggaggaggtgccgtcgcctccgccaccgctgccgccgccgccaggggtaggagctaagccgccgccattttgtgtccccctgttgttgtcgttgacatgaatccgacatgacactgattacagcccaatggagtctcattaaacccgagtcgcggtcccgccccgccgctgctccattggaggagaccaaagacacttaaggccacccgttggcctacgggtctgtctgtcacccactcactaaccactctgcagcccattggggcaggttcctgccggtcatntcgcttccaataaacacaccccttcgaccccatnattcccccccttcgggaaccacccccgggggaggggtccactggncaataccaattnaanagaaccgctngggtccgcctntttncgggcnccctattgggtt

SEQ ID NO: 127 - DNA, 717 bp, Artificial Sequence
  STAR elements in STAR4 forward
  misc_feature (444)..(444): the 'n' at position 444 may be any nucleic acid
  misc_feature (446)..(446): the 'n' at position 446 may be any nucleic acid
  misc_feature (532)..(532): the 'n' at position 532 may be any nucleic acid
  misc_feature (534)..(534): the 'n' at position 534 may be any nucleic acid
  misc_feature (545)..(545): the 'n' at position 545 may be any nucleic acid
  misc_feature (559)..(559): the 'n' at position 559 may be any nucleic acid
  misc_feature (563)..(563): the 'n' at position 563 may be any nucleic acid
  misc_feature (568)..(568): the 'n' at position 568 may be any nucleic acid
  misc_feature (579)..(579): the 'n' at position 579 may be any nucleic acid
  misc_feature (585)..(585): the 'n' at position 585 may be any nucleic acid
  misc_feature (605)..(605): the 'n' at position 605 may be any nucleic acid
  misc_feature (616)..(616): the 'n' at position 616 may be any nucleic acid
  misc_feature (636)..(636): the 'n' at position 636 may be any nucleic acid
  misc_feature (638)..(638): the 'n' at position 638 may be any nucleic acid
  misc_feature (656)..(656): the 'n' at position 656 may be any nucleic acid
  misc_feature (667)..(667): the 'n' at position 667 may be any nucleic acid
  misc_feature (675)..(675): the 'n' at position 675 may be any nucleic acid
  misc_feature (688)..(688): the 'n' at position 688 may be any nucleic acid
  misc_feature (690)..(690): the 'n' at position 690 may be any nucleic acid
  misc_feature (692)..(692): the 'n' at position 692 may be any nucleic acid
  misc_feature (701)..(701): the 'n' at position 701 may be any nucleic acid
  misc_feature (704)..(704): the 'n' at position 704 may be any nucleic acid
ggggaggattcttttggctgctgagttgagattaggttgagggtagtgaaggtaaaggcagtgagaccacgtaggggtcattgcagtaatccaggctggagatgatggtggttcagttggaatagcagtgcatgtgctgtaacaacctcagctgggaagcagtatatgtggcgttatgacctcagctggaacagcaatgcatgtggtggtgtaatgaccccagctgggtagggtgcatgtgatggaacaacctcagctgggtagcagtgtacttgataaaatgttggcatactctacatttgttatgagggtagtgccattaaatttctccacaaattggttgtcacgtatgagtgaaaagaggaagtgatggaagacttcagtgcttttggcctgaataaatagaagacgtcattttcagtaatggagacagggaagactaangnagggtggattcagtagagcaggtgttcagttttgaatatgatgaactctgagagaggaaaaactttttctacctcttagtttttgngnctggacttaanattaaaggacatangacngagancagaccaaatntgcgangtttttatattttacttgcngagggaatttncaagaaaaagaagacccaananccattggtcaaaactatntgccttttaanaaaaaganaattacaatgganananaagtgttgnctnggcaaaaattggg

SEQ ID NO: 128 - DNA, 541 bp, Artificial Sequence
  STAR elements in STAR4 reverse
  misc_feature (6)..(6): the 'n' at position 6 may be any nucleic acid
  misc_feature (101)..(101): the 'n' at position 101 may be any nucleic acid
  misc_feature (320)..(320): the 'n' at position 320 may be any nucleic acid
  misc_feature (352)..(352): the 'n' at position 352 may be any nucleic acid
  misc_feature (395)..(395): the 'n' at position 395 may be any nucleic acid
  misc_feature (404)..(404): the 'n' at position 404 may be any nucleic acid
  misc_feature (480)..(481): the 'n' at positions 480-481 may be any nucleic acid
  misc_feature (493)..(493): the 'n' at position 493 may be any nucleic acid
  misc_feature (498)..(498): the 'n' at position 498 may be any nucleic acid
  misc_feature (511)..(511): the 'n' at position 511 may be any nucleic acid
  misc_feature (516)..(517): the 'n' at positions 516-517 may be any nucleic acid
  misc_feature (523)..(523): the 'n' at position 523 may be any nucleic acid
  misc_feature (526)..(526): the 'n' at position 526 may be any nucleic acid
  misc_feature (533)..(533): the 'n' at position 533 may be any nucleic acid
ggattngagctagcggcgcgccaagcttggatcttagaaggacagagtggggcatggaaatgcaccaccagggcagtgcagcttggtcactgccagctccnctcatgggcagagggctggcctcttgcagccgaccaggcactgagcgccatcccagggccctcgccagccctcagcagggccaggacacacaagcctttgacttcctcctgtcactgctgctgccattcctgttttgtggtcatcactccttccctgtcctcagactgcccagcactcaaggatgtcctgtggtggcatcagaccatatgcccctgaanaggagtgagttggtgttttttgccgcgcccanagagctgctgtcccctgaaagatgcaagtgggaatgatgatgntcaccatcntctgacaccaagccctttggatagaggccccaacagtgaggatggggctgcactgcattgccaaggcaactctgtnntgactgctacangacantcccaggacctgngaagnnctatanatntgatgcnaggcacct

SEQ ID NO: 129 - DNA, 794 bp, Artificial Sequence
  STAR elements in STAR6 forward
  misc_feature (374)..(374): the 'n' at position 374 may be any nucleic acid
  misc_feature (394)..(394): the 'n' at position 394 may be any nucleic acid
  misc_feature (427)..(427): the 'n' at position 427 may be any nucleic acid
  misc_feature (444)..(444): the 'n' at position 444 may be any nucleic acid
  misc_feature (480)..(480): the 'n' at position 480 may be any nucleic acid
  misc_feature (500)..(500): the 'n' at position 500 may be any nucleic acid
  misc_feature (503)..(503): the 'n' at position 503 may be any nucleic acid
  misc_feature (527)..(527): the 'n' at position 527 may be any nucleic acid
  misc_feature (550)..(551): the 'n' at positions 550-551 may be any nucleic acid
  misc_feature (557)..(557): the 'n' at position 557 may be any nucleic acid
  misc_feature (559)..(559): the 'n' at position 559 may be any nucleic acid
  misc_feature (561)..(561): the 'n' at position 561 may be any nucleic acid
  misc_feature (564)..(564): the 'n' at position 564 may be any nucleic acid
  misc_feature (570)..(570): the 'n' at position 570 may be any nucleic acid
  misc_feature (574)..(574): the 'n' at position 574 may be any nucleic acid
  misc_feature (587)..(587): the 'n' at position 587 may be any nucleic acid
  misc_feature (600)..(600): the 'n' at position 600 may be any nucleic acid
  misc_feature (604)..(604): the 'n' at position 604 may be any nucleic acid
  misc_feature (606)..(606): the 'n' at position 606 may be any nucleic acid
  misc_feature (609)..(609): the 'n' at position 609 may be any nucleic acid
  misc_feature (629)..(629): the 'n' at position 629 may be any nucleic acid
  misc_feature (640)..(640): the 'n' at position 640 may be any nucleic acid
  misc_feature (653)..(653): the 'n' at position 653 may be any nucleic acid
  misc_feature (655)..(655): the 'n' at position 655 may be any nucleic acid
  misc_feature (657)..(657): the 'n' at position 657 may be any nucleic acid
  misc_feature (671)..(671): the 'n' at position 671 may be any nucleic acid
  misc_feature (677)..(677): the 'n' at position 677 may be any nucleic acid
  misc_feature (681)..(682): the 'n' at positions 681-682 may be any nucleic acid
  misc_feature (687)..(701): the 'n' at positions 687-701 may be any nucleic acid
  misc_feature (703)..(704): the 'n' at positions 703-704 may be any nucleic acid
  misc_feature (706)..(706): the 'n' at position 706 may be any nucleic acid
  misc_feature (718)..(720): the 'n' at positions 718-720 may be any nucleic acid
  misc_feature (726)..(728): the 'n' at positions 726-728 may be any nucleic acid
  misc_feature (736)..(736): the 'n' at position 736 may be any nucleic acid
  misc_feature (744)..(744): the 'n' at position 744 may be any nucleic acid
  misc_feature (746)..(746): the 'n' at position 746 may be any nucleic acid
  misc_feature (751)..(751): the 'n' at position 751 may be any nucleic acid
  misc_feature (758)..(758): the 'n' at position 758 may be any nucleic acid
  misc_feature (765)..(765): the 'n' at position 765 may be any nucleic acid
  misc_feature (769)..(769): the 'n' at position 769 may be any nucleic acid
  misc_feature (772)..(772): the 'n' at position 772 may be any nucleic acid
  misc_feature (777)..(777): the 'n' at position 777 may be any nucleic acid
  misc_feature (792)..(792): the 'n' at position 792 may be any nucleic acid
ccaccacagacatcccctctggcctcctgagtggtttcttcagcacagcttccagagccaaattaaacgttcactctatgtctatagacaaaaagggttttgactaaactctgtgttttagagagggagttaaatgctgttaactttttaggggtgggcgagaggaatgacaaataacaacttgtctgaatgttttacatttctccccactgcctcaagaaggttcacaacgaggtcatccatgataaggagtaagacctcccagccggactgtccctcggcccccagaggacactccacagagatatgctaactggacttggagactggctcacactccagagaaaagcatggagcacgagcgcacagagcangggccaaggtcccagggacngaatgtctaggagggagattggggtgagggtantctgatgcaattactgngcagctcaacattcaagggaggggaagaaagaaacngtccctgtaagtaagttgtncancagagatggtaagctccaaatttnaactttggctgctggaaagtttnngggccnananaanaaacanaaanatttgaggtttanacccactaacccntatnantanttattaatacccctaattanaccttggatanccttaaaatatcntntnaaacggaaccctcnttcccntttnnaaatnnnaaaggccattnngnncnagtaaaaatctnnnttaagnnntgggcccnaacaaacntnttccnagacacnttttttntccnggnatttntaatttatttctaancc

SEQ ID NO: 130 - DNA, 379 bp, Artificial Sequence
  STAR elements in STAR6 reverse
  misc_feature (287)..(287): the 'n' at position 287 may be any nucleic acid
  misc_feature (293)..(293): the 'n' at position 293 may be any nucleic acid
  misc_feature (342)..(342): the 'n' at position 342 may be any nucleic acid
  misc_feature (379)..(379): the 'n' at position 379 may be any nucleic acid
atcgtgtcctttccagggacatggatgaagctggaagccatcatcctcagcaaactaacacaggaacagaaaaccaaataccacatgttctcactcataagtgggagctgaacagtgagaacacatggacacagggaggggaacatcacacaccaaggcctgtctggtgtggggaggggagggagagcatcaggacaaatagctaatgcatgtggggcttaaacctagatgacgggttgataggtgcagcaatccactatggacacatatacctatgtaacaacccnaccttnttgacatgtatcccagaacttaaaggaaaataaaaattaaaaaaaattnccctggaataaaaaagagtgtggactttggtgagatn

SEQ ID NO: 131 - DNA, 398 bp, Artificial Sequence
  STAR elements in STAR8 forward
  misc_feature (98)..(98): the 'n' at position 98 may be any nucleic acid
  misc_feature (205)..(205): the 'n' at position 205 may be any nucleic acid
  misc_feature (286)..(286): the 'n' at position 286 may be any nucleic acid
  misc_feature (299)..(299): the 'n' at position 299 may be any nucleic acid
  misc_feature (302)..(302): the 'n' at position 302 may be any nucleic acid
  misc_feature (309)..(309): the 'n' at position 309 may be any nucleic acid
  misc_feature (322)..(322): the 'n' at position 322 may be any nucleic acid
  misc_feature (342)..(342): the 'n' at position 342 may be any nucleic acid
  misc_feature (354)..(354): the 'n' at position 354 may be any nucleic acid
  misc_feature (359)..(359): the 'n' at position 359 may be any nucleic acid
  misc_feature (395)..(395): the 'n' at position 395 may be any nucleic acid
ggatcacctcgaagagagtctaacgtccgtaggaacgctctcgggttcacaaggattgaccgaaccccaggatacgtcgctctccatctgaggcttgntccaaatggccctccactattccaggcacgtgggtgtctcccctaactctccctgctctcctgagcccatgctgcctatcacccatcggtgcaggtcctttctgaanagctcgggtggattctctccatcccacttcctttcccaagaaagaagccaccgttccaagacacccaatgggacattcccnttccacctccttntcnaaagttngcccaggtgttcntaacaggttagggagagaancccccaggtttnagttncaaggcataggacgctggcttgaacacacacacacnctc

SEQ ID NO: 132 - DNA, 309 bp, Artificial Sequence
  STAR elements in STAR8 reverse
  misc_feature (72)..(72): the 'n' at position 72 may be any nucleic acid
ggatcccgactctgcaccgcaaactctacggcgccctgcaggacggcggcctcctgccgcttggacgccagncaggagctccccggcagcagcagagcagaaagaaggatggccccgccccacttcgcctcccggcggtctccctcccgccggctcacggacatagatggctgcctagctccggaagcctagctcttgttccgggcatcctaaggaagacacggtttttcctcccggggcctcaccacatctgggactttgacgactcggacctctctccattgaatggttgcgcgttctctgggaaag

SEQ ID NO: 133 - DNA, 606 bp, Artificial Sequence
  STAR elements in STAR18 forward
  misc_feature (524)..(524): the 'n' at position 524 may be any nucleic acid
tggatcctgccgctcgcgtcttagtgtttctccctcaagactttccttctgttttgttgtcttgtgcagtattttacagcccctcttgtgtttttctttatttctcgtacacacacgcagttttaagggtgatgtgtgtataattaaaaggacccttggcccatactttcctaattctttagggactgggattgggtttgactgaaatatgttttggtggggatgggacggtggacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccgagctttggcttgcgcgtatttttccggtcgcggacatcccaccgcgcagagcctcgcctccccgctgncctcagctccgatgacttccccgcccccgccctgctcggtgacagacgttctactgcttccaatcggaggcacccttcgcgg

SEQ ID NO: 134 - DNA, 465 bp, Artificial Sequence
  STAR elements in STAR18 reverse
tggatcctgccgctcgcgtcttagtgtttctccctcaagactttccttctgttttgttgtcttgtgcagtattttacagcccctcttgtgtttttctttatttctcgtacacacacgcagttttaagggtgatgtgtgtataattaaaaggacccttggcccatactttcctaattctttagggactgggattgggtttgactgaaatatgttttggtggggatgggacggtggacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccgagctttggc

SEQ ID NO: 135 - DNA, 565 bp, Artificial Sequence
  sinc elements PSINKS 9
gatcaggataataagtacgctgggaagacaacaaaatgatttaaatcttagacaagtcattctaggtgtctccactgtttcagttcttgcattcattcttgtggtatcttttcccttttaccaataaaaaagctccctgacatcacattgtggcagtccccatggtttgccgcagttactgcgggactgaacgaaggaggacgaatgaagaaatgaaaaccaaggaaaaaaggagctgtttaaagaagggtccagggaagaagaagagggctcccagcttctagtgagcaagggcagcagccctgagcttctacagcccttcatatttattgagtagaaagagcagggagcaggaggtaatgattggtcagcttctcaattgatcacaggttcacattattgctaacagatttcacatgtgcctaatctcaagaaacgccgcgcctggggcatgactgccctcagcattccctctgggtggcagacgcagtttgccaacattctgcattcatgagaacagtttactgtttactcatataacctccagtggtacaccgagttgatc

SEQ ID NO: 136 - DNA, 571 bp, Artificial Sequence
  sinc elements PSINKS 12
  misc_feature (522)..(522): the 'n' at position 522 may be any nucleic acid
gatctaatttctctgtatttaattcccatgtctattttgtctattttcaagattgatttacattgcaggttccgatgcaaccactgacttacattgcaggttctaatgtaaccactgtccttaacgagtacatagatttgtttccttctctccaggagcatgagatttgttgcctccaggaaaggcaacaaatctactattccttaaggacagtggttctcaaaggattgtcctgggaacagcagcatcacctacacagtagttagaaatgcacattctgaggcctcccaagacctgctaactcagacacttggggagaagaaggggttccaacaagccttctaggtcattctgatgcatgctggagtttgagaatcgatgctctaggaaaaacaccagtactatctaccatcaacttgaccactcaagtgtcaccattcactgaagtttaactacaatgtccagagaattaattgtgtaccaggcactatgcggaaggctgaatgctgcctcacaatccanagtggtatgtgtgtaaatgactaaataaaatgcaaaatgggatgacatg

SEQ ID NO: 137 - DNA, 553 bp, Artificial Sequence
  sinc elemens PSINKS 19
gatcctccatctgctccacccacttccatgtaagtgatcctgggctgatcacttcctctctctagacttcgtttcttttttttcttttttagaccgagtctcactctgtcacccaggctggagtgcagtggtgagatcttggctcactgcaacctccacctcctgggttcaagcaattctcctgtctcagcctcctgagtagataggactataggtgcacaccaccatacctagctaatttttgtttttttagtagagatggggtttcaccatattggtcagcctgttctcaaactcctgacctcaggtgatccacccacctcagcctcccaaagtgctgggattacaggtgtgagccaccgagccgggctgcccttctctggactttgatttcctcatctataaaacagacaacaatccctactatgaccatccagaagggttaatctatgcttcattgcaatcctaatcaaaaatcccaacattttggccgtggagcctgcccagatggttctaggatttatttggatgggaaaatagtcaagacaagctt

SEQ ID NO: 138 - DNA, 881 bp, Artificial Sequence
  sinc elements PSINKS 28
gatcatggagggagagaacaaccaaccacacactgactggtcacccctgaagttcacagccactaccctgtagaggccccgaggttgccggcaagcccagtatacttccatctaaactccccttgcacctgctcctcctgttccagacaatgagctgtaacacgcacatccacaccacacatcacccacagcaggggcaggaggcagctaagcatgggcttcagagtcctcccaccagcagcgcctaccagctacaagcctgacgtctctgtgtgtgtgtgtaaatttcactaaatatttcttcctttgttttttaaaaatttacatgaaatgcacatttttgctgtgacagaagcatgtaactgtgatcctaacacacctactcctccgccttttactgccgtctgcttccctctcttctccacgcccactcgactgcagtatcgatgccaacaacatgatgtgtgtccttccatgtttccctgctcatgcattcgcatgtaagccaccgcacatgtcactgtatgtacacacaggggattctgaggccaatgttttacaaggattacgttatacacccttttctgcagtgagtttttcccaggcaacctcccaggccccatggtgtagctctgggtcaatccttttttttttttttggagacagagtctcactctgtcgcccaggctggagtgcagtggtgcaatttgggctcactgcaacctccgcctcccgggttcaagcgattctcctgcctcagcctcctgagtagctgacattacaagcgcgcactaccacacccggctaatttttgtatttttagtagagatacagtttcaccatgttggtcaggctggtcttgaactcctgagctcgtgatc

SEQ ID NO: 139 - DNA, 632 bp, Artificial Sequence
  sinc elements PSINKS 30
gatccacccgcctcggactcccaaagtgctgggattacaggtgtgagccactgtgcttggcccgaatcaggaataattctgatggctaaggaagacagcttccgagagagtaggagaaagggcacaggattccaggcagaaggcccatctagggcaaaggcgaaggtgtggctcagcctgcctcctttggggaatggcgagtgtgttctgggctcagggttcttggtaagggacagagaagactcgggaaagatcagttgagctggaatgtgcaggctcttgagtaccctgctcaggagctggaggtgggctaccctgcaaactccaggccatgaagcccaggaagatgtcaggctggtcttcccatgcccttgtgtatctgagaccaactgtcactaaatgtttcctttacgccctggacacacagctagactctacttctcagattctcttgaaatacaagtctttagccagagggtgtggagggaaatgctgtgtatcactttgaggttgaggccatcaaagcctcccacaggtggccccctctttctctccccacgtacttatgatgttgatgcccaaggcagcttgagtactacctgctgaaggcagggcctctgtcaccatagatc

SEQ ID NO: 140 - DNA, 573 bp, Artificial Sequence
  sinc elements PSINKS 35
gatccacctgcctcggcctcccaaagtgctgggattacaggcatgagccaccatgcctggccaaaaacttctacctgcttggaaagttgactggtcacacagcctagcaaatgaggttgggatgtgggatgtgcctggttccaatcccagccctttactgttcccataggaggtggggacaggcctcacccaggcgtccagcatcctgcagctgaatcttgagcatttccatgggacaggtcaccacgacctggcacatcccagccccacacccggcaagcatctccatcttcaggttccgctgcatcctatgggaacaggcgtcaggctccttcagccgcaggccacaggcctgccctggtgcagctgccctcttgtgagagggggactttccctggatggcacccgtggctgccactcacccagctggtcaagtcatcagctagcccttaggtgtggtctctgtacggacaggggactaagtttaaaacaaagcctgctagggaggtagcaccgcatggaagctgaaacagtgacagagaaaactacccagaccaggcgttgtccttgatc

SEQ ID NO: 141 - DNA, 48 bp, Artificial Sequence
  oligonucleotide C65
aacaagcttgatatcagatctgctagcttggtcgagctgatacttccc

SEQ ID NO: 142 - DNA, 54 bp, Artificial Sequence
  oligonucleotide C66
aaactcgagcggccgcgaattcgtcgactttaccactccctatcagtgatagag

SEQ ID NO: 143 - DNA, 39 bp, Artificial Sequence
  oligonucleotide C67
aaaccgcggcatggaagacgccaaaaacataaagaaagg

SEQ ID NO: 144 - DNA, 32 bp, Artificial Sequence
  oligonucleotide C68
tatggatcctagaattacacggcgatctttcc

SEQ ID NO: 145 - DNA, 33 bp, Artificial Sequence
  oligonucleotide C81
aaaccatggccgagtacaagcccacggtgcgcc

SEQ ID NO: 146 - DNA, 35 bp, Artificial Sequence
  oligonucleotide C82
aaatctagatcaggcaccgggcttgcgggtcatgc

SEQ ID NO: 147 - DNA, 22 bp, Artificial Sequence
  oligonucleotide C85
catttccccgaaaagtgccacc

SEQ ID NO: 148 - DNA, 24 bp, Artificial Sequence
  oligonucleotide D30
tcactgctagcgagtggtaaactc

SEQ ID NO: 149 - DNA, 28 bp, Artificial Sequence
  oligonucleotide D41
gaagtcgacgaggcaggcagaagtatgc

SEQ ID NO: 150 - DNA, 29 bp, Artificial Sequence
  oligonucleotide D42
gagccgcggtttagttcctcaccttgtcg

SEQ ID NO: 151 - DNA, 23 bp, Artificial Sequence
  oligonucleotide D51
tctggaagctttgctgaagaaac

SEQ ID NO: 152 - DNA, 21 bp, Artificial Sequence
  oligonucleotide D89
gggcaagatgtcgtagtcagg

SEQ ID NO: 153 - DNA, 30 bp, Artificial Sequence
  oligonucleotide D90
aggcccatggtcacctccatcgctactgtg

SEQ ID NO: 154 - DNA, 20 bp, Artificial Sequence
  oligonucleotide D91
ctaatcactcactgtgtaat

SEQ ID NO: 155 - DNA, 15 bp, Artificial Sequence
  oligonucleotide D93
aattacaggcgcgcc

SEQ ID NO: 156 - DNA, 15 bp, Artificial Sequence
  oligonucleotide D94
aattggcgcgcctgt

SEQ ID NO: 157 - DNA, 25 bp, Artificial Sequence
  oligonucleotide D95
tgctttgcatacttctgcctgcctc

SEQ ID NO: 158 - DNA, 20 bp, Artificial Sequence
  oligonucleotide E12
taggggggatccaaatgttc

SEQ ID NO: 159 - DNA, 20 bp, Artificial Sequence
  oligonucleotide E13
cctaaaagaagatctttagc

SEQ ID NO: 160 - DNA, 20 bp, Artificial Sequence
  oligonucleotide E14
aagtgttggatccactttgg

SEQ ID NO: 161 - DNA, 20 bp, Artificial Sequence
  oligonucleotide E15
tttgaagatctaccaaatgg

SEQ ID NO: 162 - DNA, 20 bp, Artificial Sequence
  oligonucleotide E16
gttcgggatccacctggccg

SEQ ID NO: 163 - DNA, 20 bp, Artificial Sequence
  oligonucleotide E17
taggcaagatcttggccctc

SEQ ID NO: 164 - DNA, 20 bp, Artificial Sequence
  oligonucleotide E18
cctctctagggatccgaccc

SEQ ID NO: 165 - DNA, 20 bp, Artificial Sequence
  oligonucleotide E19
ctagagagatcttccagtat

SEQ ID NO: 166 - DNA, 20 bp, Artificial Sequence
  oligonucleotide E20
agagttccggatccgcctgg

SEQ ID NO: 167 - DNA, 20 bp, Artificial Sequence
  oligonucleotide E21
ccaggcagactcggaactct

SEQ ID NO: 168 - DNA, 20 bp, Artificial Sequence
  oligonucleotide E22
tggtgaaaccggatccctac

SEQ ID NO: 169 - DNA, 20 bp, Artificial Sequence
  oligonucleotide E23
aggtcaggagatctagacca

SEQ ID NO: 170 - DNA, 22 bp, Artificial Sequence
  oligonucleotide E25
ccattttcgcttccttagctcc

SEQ ID NO: 171 - DNA, 22 bp, Artificial Sequence
  oligonucleotide E42
cgatgtaacccactcgtgcacc

SEQ ID NO: 172 - DNA, 20 bp, Artificial Sequence
  oligonucleotide E57
agagatctaggataatttcg

SEQ ID NO: 173 - DNA, 36 bp, Artificial Sequence
  oligonucleotide E92
aggcgctagcacgcgttctactcttttcctactctg

SEQ ID NO: 174 - DNA, 35 bp, Artificial Sequence
  oligonucleotide E93
gatcaagcttacgcgtctaaaggcattttatatag

SEQ ID NO: 175 - DNA, 35 bp, Artificial Sequence
  oligonucleotide E94
aggcgctagcacgcgttcagagttagtgatccagg

SEQ ID NO: 176 - DNA, 35 bp, Artificial Sequence
  oligonucleotide E95
gatcaagcttacgcgtcagtaaaggtttcgtatgg

SEQ ID NO: 177 - DNA, 36 bp, Artificial Sequence
  oligonucleotide E96
aggcgctagcacgcgttctactctttcattactctg

SEQ ID NO: 178 - DNA, 26 bp, Artificial Sequence
  oligonucleotide E97
cgaggaagctggagaaggagaagctg

SEQ ID NO: 179 - DNA, 25 bp, Artificial Sequence
  oligonucleotide E98
caagggccgcagcttacacatgttc

SEQ ID NO: 180 - DNA, 17 bp, Artificial Sequence
  oligonucleotide D58
ccaagttgaccagtgcc

SEQ ID NO: 181 - DNA, 20 bp, Artificial Sequence
  oligonucleotide D80
gttcgtggacacgacctccg

SEQ ID NO: 182 - DNA, 19 bp, Artificial Sequence
  oligonucleotide D70
tacaagccaaccacggcct

SEQ ID NO: 183 - DNA, 20 bp, Artificial Sequence
  oligonucleotide D71
cggaagtgcttgacattggg

SEQ ID NO: 184 - DNA, 6 bp, Artificial Sequence
  oligonucleotide patterns over-represented in STAR elements
ccccac

SEQ ID NO: 185 - DNA, 6 bp, Artificial Sequence
  oligonucleotide patterns over-represented in STAR elements
cagcgg

SEQ ID NO: 186 - DNA, 6 bp, Artificial Sequence
  oligonucleotide patterns over-represented in STAR elements
ggcccc

SEQ ID NO: 187 - DNA, 6 bp, Artificial Sequence
  oligonucleotide patterns over-represented in STAR elements
cagccc

SEQ ID NO: 188 - DNA, 6 bp, Artificial Sequence
  oligonucleotide patterns over-represented in STAR elements
gccccc

SEQ ID NO: 189 - DNA, 6 bp, Artificial Sequence
  oligonucleotide patterns over-represented in STAR patterns
cggggc

SEQ ID NO: 190 - DNA, 6 bp, Artificial Sequence
  oligonucleotide patterns over-represented in STAR elements
ccccgc

SEQ ID NO: 191 - DNA, 6 bp, Artificial Sequence
  oligonucleotide patterns over-represented in STAR elements
cggcag

SEQ ID NO: 192 - DNA, 6 bp, Artificial Sequence
  oligonucleotide patterns over-represented in STAR elements
agcccc

SEQ ID NO: 193 - DNA, 6 bp, Artificial Sequence
  oligonucleotide patterns over-represented in STAR elements
ccaggg

SEQ ID NO: 194 - DNA, 6 bp, Artificial Sequence
  oligonucleotide patterns over-represetned in STAR elements
ggaccc

SEQ ID NO: 195 - DNA, 6 bp, Artificial Sequence
  oligonucleotide patterns over-represented in STAR elements
gcggac

SEQ ID NO: 196 - DNA, 6 bp, Artificial Sequence
  oligonucleotide patterns over-represented in STAR elements
ccagcg

SEQ ID NO: 197 - DNA, 6 bp, Artificial Sequence
  oligonucleotide patterns over-represented in STAR elements
gcagcc

SEQ ID NO: 198 - DNA, 6 bp, Artificial Sequence
  oligonucleotide patterns over-represented in STAR elements
ccggca

SEQ ID NO: 199 - DNA, 6 bp, Artificial Sequence
  oligonucleotide patterns over-represented in STAR elements
agcggc

SEQ ID NO: 200 - DNA, 6 bp, Artificial Sequence
  oligonucleotide patterns over-represented in STAR elements
cagggg

SEQ ID NO: 201 - DNA, 6 bp, Artificial Sequence
  oligonucleotide patterns over-represented in STAR elements
ccgccc

SEQ ID NO: 202 - DNA, 6 bp, Artificial Sequence
  oligonucleotide patterns over-represented in STAR elements
cccccg

SEQ ID NO: 203 - DNA, 6 bp, Artificial Sequence
  oligonucleotide patterns over-represented in STAR elements
gccgcc

SEQ ID NO: 204 - DNA, 6 bp, Artificial Sequence
  oligonucleotide patterns over-represented in STAR elements
gccggc

SEQ ID NO: 205 - DNA, 6 bp, Artificial Sequence
  oligonucleotide patterns over-represented in STAR elements
cggacc

SEQ ID NO: 206 - DNA, 6 bp, Artificial Sequence
  oligonucleotide patterns over-represented in STAR elements
cgcccc

SEQ ID NO: 207 - DNA, 6 bp, Artificial Sequence
  oligonucleotide patterns over-represented in STAR elements
cgccag

SEQ ID NO: 208 - DNA, 6 bp, Artificial Sequence
  oligonucleotide patterns over-represented in STAR elements
cgcagc

SEQ ID NO: 209 - DNA, 6 bp, Artificial Sequence
  oligonucleotide patterns over-represented in STAR elements
cagccg

SEQ ID NO: 210 - DNA, 6 bp, Artificial Sequence
  oligonucleotide patterns over-represented in STAR elements
cccacg

SEQ ID NO: 211 - DNA, 6 bp, Artificial Sequence
  oligonucleotide patterns over-represented in STAR elements
gctgcc

SEQ ID NO: 212 - DNA, 6 bp, Artificial Sequence
  oligonucleotide patterns over-represented in STAR elements
ccctcc

SEQ ID NO: 213 - DNA, 6 bp, Artificial Sequence
  oligonucleotide patterns over-represented in STAR elements
ccctgc

SEQ ID NO: 214 - DNA, 6 bp, Artificial Sequence
  oligonucleotide patterns over-represented in STAR elements
cacccc

SEQ ID NO: 215 - DNA, 6 bp, Artificial Sequence
  oligonucleotide patterns over-represented in STAR elements
gcgcca

SEQ ID NO: 216 - DNA, 6 bp, Artificial Sequence
  oligonucleotide patterns over-represented in STAR elements
aggggc

SEQ ID NO: 217 - DNA, 6 bp, Artificial Sequence
  oligonucleotide patterns over-represented in STAR elements
gagggc

SEQ ID NO: 218 - DNA, 6 bp, Artificial Sequence
  oligonucleotide patterns over-represented in STAR elements
gcgaac

SEQ ID NO: 219 - DNA, 6 bp, Artificial Sequence
  oligonucleotide patterns over-represented in STAR elements
ccggcg

SEQ ID NO: 220 - DNA, 6 bp, Artificial Sequence
  oligonucleotide patterns over-represented in STAR elements
agccgg

SEQ ID NO: 221 - DNA, 6 bp, Artificial Sequence
  oligonucleotide patterns over-represented in STAR elements
ggagcc

SEQ ID NO: 222 - DNA, 6 bp, Artificial Sequence
  oligonucleotide patterns over-represented in STAR elements
ccccag

SEQ ID NO: 223 - DNA, 6 bp, Artificial Sequence
  oligonucleotide patterns over-represented in STAR elements
ccgctc

SEQ ID NO: 224 - DNA, 6 bp, Artificial Sequence
  oligonucleotide patterns over-represented in STAR elements
cccctc

SEQ ID NO: 225 - DNA, 6 bp, Artificial Sequence
  oligonucleotide patterns over-represented in STAR elements
caccgc

SEQ ID NO: 226 - DNA, 6 bp, Artificial Sequence
  oligonucleotide patterns over-represented in STAR elements
ctgccc

SEQ ID NO: 227 - DNA, 6 bp, Artificial Sequence
  oligonucleotide patterns over-represented in STAR elements
gggcca

SEQ ID NO: 228 - DNA, 6 bp, Artificial Sequence
  oligonucleotide patterns over-represented in STAR elements
cgctgc

SEQ ID NO: 229 - DNA, 6 bp, Artificial Sequence
  oligonucleotide patterns over-represented in STAR elements
cagcgc

SEQ ID NO: 230 - DNA, 6 bp, Artificial Sequence
  oligonucleotide patterns over-represented in STAR elements
cggccc

SEQ ID NO: 231 - DNA, 6 bp, Artificial Sequence
  oligonucleotide patterns over-represented in STAR elements
ccgccg

SEQ ID NO: 232 - DNA, 6 bp, Artificial Sequence
  oligonucleotide patterns over-represented in STAR elements
ccccgg

SEQ ID NO: 233 - DNA, 6 bp, Artificial Sequence
  oligonucleotide patterns over-represented in STAR elements
agccgc

SEQ ID NO: 234 - DNA, 6 bp, Artificial Sequence
  oligonucleotide patterns over-represented in STAR elements
gcaccc

SEQ ID NO: 235 - DNA, 6 bp, Artificial Sequence
  oligonucleotide patterns over-represented in STAR elements
aggacc

SEQ ID NO: 236 - DNA, 6 bp, Artificial Sequence
  oligonucleotide patterns over-represented in STAR elements
agggcg

SEQ ID NO: 237 - DNA, 6 bp, Artificial Sequence
  oligonucleotide patterns over-represented in STAR elements
cagggc

SEQ ID NO: 238 - DNA, 6 bp, Artificial Sequence
  oligonucleotide patterns over-represented in STAR elements
cccgcc

SEQ ID NO: 239 - DNA, 6 bp, Artificial Sequence
  oligonucleotide patterns over-represented in STAR elements
gccagc

SEQ ID NO: 240 - DNA, 6 bp, Artificial Sequence
  oligonucleotide patterns over-represented in STAR elements
agcgcc

SEQ ID NO: 241 - DNA, 6 bp, Artificial Sequence
  oligonucleotide patterns over-represented in STAR elements
aggccc

SEQ ID NO: 242 - DNA, 6 bp, Artificial Sequence
  oligonucleotide patterns over-represented in STAR elements
cccacc

SEQ ID NO: 243 - DNA, 6 bp, Artificial Sequence
  oligonucleotide patterns over-represented in STAR elements
cgctca

SEQ ID NO: 244 - DNA, 6 bp, Artificial Sequence
  oligonucleotide patterns over-represented in STAR elements
aacgcg

SEQ ID NO: 245 - DNA, 6 bp, Artificial Sequence
  oligonucleotide patterns over-represented in STAR elements
gcggca

SEQ ID NO: 246 - DNA, 6 bp, Artificial Sequence
  oligonucleotide patterns over-represented in STAR elements
aggtcc

SEQ ID NO: 247 - DNA, 6 bp, Artificial Sequence
  oligonucleotide patterns over-represented in STAR elements
ccgtca

SEQ ID NO: 248 - DNA, 6 bp, Artificial Sequence
  oligonucleotide patterns over-represented in STAR elements
cagagg

SEQ ID NO: 249 - DNA, 6 bp, Artificial Sequence
  oligonucleotide patterns over-represented in STAR elements
cccgag

SEQ ID NO: 250 - DNA, 6 bp, Artificial Sequence
  oligonucleotide patterns over-represented in STAR elements
ccgagg

SEQ ID NO: 251 - DNA, 6 bp, Artificial Sequence
  oligonucleotide patterns over-represented in STAR elements
cgcgga

SEQ ID NO: 252 - DNA, 6 bp, Artificial Sequence
  oligonucleotide patterns over-represented in STAR elements
ccaccc

SEQ ID NO: 253 - DNA, 6 bp, Artificial Sequence
  oligonucleotide patterns over-represented in STAR elements
cctcgc

SEQ ID NO: 254 - DNA, 6 bp, Artificial Sequence
  oligonucleotide patterns over-represented in STAR elements
caagcc

SEQ ID NO: 255 - DNA, 6 bp, Artificial Sequence
  oligonucleotide patterns over-represented in STAR elements
tccgca

SEQ ID NO: 256 - DNA, 6 bp, Artificial Sequence
  oligonucleotide patterns over-represented in STAR elements
cgccgc

SEQ ID NO: 257 - DNA, 6 bp, Artificial Sequence
  oligonucleotide patterns over-represented in STAR elements
gggaac

SEQ ID NO: 258 - DNA, 6 bp, Artificial Sequence
  oligonucleotide patterns over-represented in STAR elements
ccagag

SEQ ID NO: 259 - DNA, 6 bp, Artificial Sequence
  oligonucleotide patterns over-represented in STAR elements
cgttcc

SEQ ID NO: 260 - DNA, 6 bp, Artificial Sequence
  oligonucleotide patterns over-represented in STAR elements
cgagga

SEQ ID NO: 261 - DNA, 6 bp, Artificial Sequence
  oligonucleotide patterns over-represented in STAR elements
gggacc

SEQ ID NO: 262 - DNA, 6 bp, Artificial Sequence
  oligonucleotide patterns over-represented in STAR elements
ccgcga

SEQ ID NO: 263 - DNA, 6 bp, Artificial Sequence
  oligonucleotide patterns over-represented in STAR elements
cctgcg

SEQ ID NO: 264 - DNA, 6 bp, Artificial Sequence
  oligonucleotide patterns over-represented in STAR elements
ctgcgc

SEQ ID NO: 265 - DNA, 6 bp, Artificial Sequence
  oligonucleotide patterns over-represented in STAR elements
gacccc

SEQ ID NO: 266 - DNA, 6 bp, Artificial Sequence
  oligonucleotide patterns over-represented in STAR elements
gctcca

SEQ ID NO: 267 - DNA, 6 bp, Artificial Sequence
  oligonucleotide patterns over-represented in STAR elements
cgccac

SEQ ID NO: 268 - DNA, 6 bp, Artificial Sequence
  oligonucleotide patterns over-represented in STAR elements
gcggga

SEQ ID NO: 269 - DNA, 6 bp, Artificial Sequence
  oligonucleotide patterns over-represented in STAR elements
ctgcga

SEQ ID NO: 270 - DNA, 6 bp, Artificial Sequence
  oligonucleotide patterns over-represented in STAR elements
ctgctc

SEQ ID NO: 271 - DNA, 6 bp, Artificial Sequence
  oligonucleotide patterns over-represented in STAR elements
cagacg

SEQ ID NO: 272 - DNA, 6 bp, Artificial Sequence
  oligonucleotide patterns over-represented in STAR elements
cgagag

SEQ ID NO: 273 - DNA, 6 bp, Artificial Sequence
  oligonucleotide patterns over-represented in STAR elements
cggtgc

SEQ ID NO: 274 - DNA, 6 bp, Artificial Sequence
  oligonucleotide patterns over-represented in STAR elements
ctcccc

SEQ ID NO: 275 - DNA, 6 bp, Artificial Sequence
  oligonucleotide patterns over-represented in STAR elements
gcggcc

SEQ ID NO: 276 - DNA, 6 bp, Artificial Sequence
  oligonucleotide patterns over-represented in STAR elements
cggcgc

SEQ ID NO: 277 - DNA, 6 bp, Artificial Sequence
  oligonucleotide patterns over-represented in STAR elements
aagccc

SEQ ID NO: 278 - DNA, 6 bp, Artificial Sequence
  oligonucleotide patterns over-represented in STAR elements
ccgcag

SEQ ID NO: 279 - DNA, 6 bp, Artificial Sequence
  oligonucleotide patterns over-represented in STAR elements
gcccac

SEQ ID NO: 280 - DNA, 6 bp, Artificial Sequence
  oligonucleotide patterns over-represented in STAR elements
caccca

SEQ ID NO: 281 - DNA, 6 bp, Artificial Sequence
  oligonucleotide patterns over-represented in STAR elements
gcgccc

SEQ ID NO: 282 - DNA, 6 bp, Artificial Sequence
  oligonucleotide patterns over-represented in STAR elements
accggc

SEQ ID NO: 283 - DNA, 6 bp, Artificial Sequence
  oligonucleotide patterns over-represented in STAR elements
ctcgca

SEQ ID NO: 284 - DNA, 6 bp, Artificial Sequence
  oligonucleotide patterns over-represented in STAR elements
acgctc

SEQ ID NO: 285 - DNA, 6 bp, Artificial Sequence
  oligonucleotide patterns over-represented in STAR elements
ctggac

SEQ ID NO: 286 - DNA, 6 bp, Artificial Sequence
  oligonucleotide patterns over-represented in STAR elements
gcccca

SEQ ID NO: 287 - DNA, 6 bp, Artificial Sequence
  oligonucleotide patterns over-represented in STAR elements
accgtc

SEQ ID NO: 288 - DNA, 6 bp, Artificial Sequence
  oligonucleotide patterns over-represented in STAR elements
ccctcg

SEQ ID NO: 289 - DNA, 6 bp, Artificial Sequence
  oligonucleotide patterns over-represented in STAR elements
agcccg

SEQ ID NO: 290 - DNA, 6 bp, Artificial Sequence
  oligonucleotide patterns over-represented in STAR elements
acccga

SEQ ID NO: 291 - DNA, 6 bp, Artificial Sequence
  oligonucleotide patterns over-represented in STAR elements
agcagc

SEQ ID NO: 292 - DNA, 6 bp, Artificial Sequence
  oligonucleotide patterns over-represented in STAR elements
accgcg

SEQ ID NO: 293 - DNA, 6 bp, Artificial Sequence
  oligonucleotide patterns over-represented in STAR elements
cgaggc

SEQ ID NO: 294 - DNA, 6 bp, Artificial Sequence
  oligonucleotide patterns over-represented in STAR elements
agctgc

SEQ ID NO: 295 - DNA, 6 bp, Artificial Sequence
  oligonucleotide patterns over-represented in STAR elements
ggggac

SEQ ID NO: 296 - DNA, 6 bp, Artificial Sequence
  oligonucleotide patterns over-represented in STAR elements
ccgcaa

SEQ ID NO: 297 - DNA, 6 bp, Artificial Sequence
  oligonucleotide patterns over-represented in STAR elements
cgtcgc

SEQ ID NO: 298 - DNA, 6 bp, Artificial Sequence
  oligonucleotide patterns over-represented in STAR elements
cgtgac

SEQ ID NO: 299 - DNA, 6 bp, Artificial Sequence
  oligonucleotide patterns over-represented in STAR elements
cgccca

SEQ ID NO: 300 - DNA, 6 bp, Artificial Sequence
  oligonucleotide patterns over-represented in STAR elements
ctctgc

SEQ ID NO: 301 - DNA, 6 bp, Artificial Sequence
  oligonucleotide patterns over-represented in STAR elements
agcggg

SEQ ID NO: 302 - DNA, 6 bp, Artificial Sequence
  oligonucleotide patterns over-represented in STAR elements
accgct

SEQ ID NO: 303 - DNA, 6 bp, Artificial Sequence
  oligonucleotide patterns over-represented in STAR elements
cccagg

SEQ ID NO: 304 - DNA, 6 bp, Artificial Sequence
  oligonucleotide patterns over-represented in STAR elements
ccctca

SEQ ID NO: 305 - DNA, 6 bp, Artificial Sequence
  oligonucleotide patterns over-represented in STAR elements
ccccca

SEQ ID NO: 306 - DNA, 6 bp, Artificial Sequence
  oligonucleotide patterns over-represented in STAR elements
ggcgaa

SEQ ID NO: 307 - DNA, 6 bp, Artificial Sequence
  oligonucleotide patterns over-represented in STAR elements
cggctc

SEQ ID NO: 308 - DNA, 6 bp, Artificial Sequence
  oligonucleotide patterns over-represented in STAR elements
ctcgcc

SEQ ID NO: 309 - DNA, 6 bp, Artificial Sequence
  oligonucleotide patterns over-represented in STAR elements
cggaga

SEQ ID NO: 310 - DNA, 6 bp, Artificial Sequence
  oligonucleotide patterns over-represented in STAR elements
tcccca

SEQ ID NO: 311 - DNA, 6 bp, Artificial Sequence
  oligonucleotide patterns over-represented in STAR elements
gacacc

SEQ ID NO: 312 - DNA, 6 bp, Artificial Sequence
  oligonucleotide patterns over-represented in STAR elements
ctccga

SEQ ID NO: 313 - DNA, 6 bp, Artificial Sequence
  oligonucleotide patterns over-represented in STAR elements
ctcgtc

SEQ ID NO: 314 - DNA, 6 bp, Artificial Sequence
  oligonucleotide patterns over-represented in STAR elements
cgacca

SEQ ID NO: 315 - DNA, 6 bp, Artificial Sequence
  oligonucleotide patterns over-represented in STAR elements
atgacg

SEQ ID NO: 316 - DNA, 6 bp, Artificial Sequence
  oligonucleotide patterns over-represented in STAR elements
ccatcg

SEQ ID NO: 317 - DNA, 6 bp, Artificial Sequence
  oligonucleotide patterns over-represented in STAR elements
agggga

SEQ ID NO: 318 - DNA, 6 bp, Artificial Sequence
  oligonucleotide patterns over-represented in STAR elements
gctgca

SEQ ID NO: 319 - DNA, 6 bp, Artificial Sequence
  oligonucleotide patterns over-represented in STAR elements
acccca

SEQ ID NO: 320 - DNA, 6 bp, Artificial Sequence
  oligonucleotide patterns over-represented in STAR elements
cggagc

SEQ ID NO: 321 - DNA, 6 bp, Artificial Sequence
  oligonucleotide patterns over-represented in STAR elements
cctccg

SEQ ID NO: 322 - DNA, 6 bp, Artificial Sequence
  oligonucleotide patterns over-represented in STAR elements
cgggac

SEQ ID NO: 323 - DNA, 6 bp, Artificial Sequence
  oligonucleotide patterns over-represented in STAR elements
cctgga

SEQ ID NO: 324 - DNA, 6 bp, Artificial Sequence
  oligonucleotide patterns over-represented in STAR elements
aggcga

SEQ ID NO: 325 - DNA, 6 bp, Artificial Sequence
  oligonucleotide patterns over-represented in STAR elements
acccct

SEQ ID NO: 326 - DNA, 6 bp, Artificial Sequence
  oligonucleotide patterns over-represented in STAR elements
gctccc

SEQ ID NO: 327 - DNA, 6 bp, Artificial Sequence
  oligonucleotide patterns over-represented in STAR elements
cgtcac

SEQ ID NO: 328 - DNA, 6 bp, Artificial Sequence
  oligonucleotide patterns over-represented in STAR elements
agcgca

SEQ ID NO: 329 - DNA, 6 bp, Artificial Sequence
  oligonucleotide patterns over-represented in STAR elements
gaagcc

SEQ ID NO: 330 - DNA, 6 bp, Artificial Sequence
  oligonucleotide patterns over-represented in STAR elements
gaggcc

SEQ ID NO: 331 - DNA, 6 bp, Artificial Sequence
  oligonucleotide patterns over-represented in STAR elements
accctc

SEQ ID NO: 332 - DNA, 6 bp, Artificial Sequence
  oligonucleotide patterns over-represented in STAR elements
cccggc

SEQ ID NO: 333 - DNA, 6 bp, Artificial Sequence
  oligonucleotide patterns over-represented in STAR elements
cgagaa

SEQ ID NO: 334 - DNA, 6 bp, Artificial Sequence
  oligonucleotide patterns over-represented in STAR elements
ccaccg

SEQ ID NO: 335 - DNA, 6 bp, Artificial Sequence
  oligonucleotide patterns over-represented in STAR elements
acttcg

SEQ ID NO: 336 - DNA, 6 bp, Artificial Sequence
  oligonucleotide patterns over-represented in STAR elements
gatgac

SEQ ID NO: 337 - DNA, 6 bp, Artificial Sequence
  oligonucleotide patterns over-represented in STAR elements
acgagg

SEQ ID NO: 338 - DNA, 6 bp, Artificial Sequence
  oligonucleotide patterns over-represented in STAR elements
ccggag

SEQ ID NO: 339 - DNA, 6 bp, Artificial Sequence
  oligonucleotide patterns over-represented in STAR elements
acccac

SEQ ID NO: 340 - DNA, 6 bp, Artificial Sequence
  oligonucleotide patterns over-represented in STAR elements
ctgggc

SEQ ID NO: 341 - DNA, 6 bp, Artificial Sequence
  oligonucleotide patterns over-represented in STAR elements
ccacgg

SEQ ID NO: 342 - DNA, 6 bp, Artificial Sequence
  oligonucleotide patterns over-represented in STAR elements
cggtcc

SEQ ID NO: 343 - DNA, 6 bp, Artificial Sequence
  oligonucleotide patterns over-represented in STAR elements
agcacc

SEQ ID NO: 344 - DNA, 6 bp, Artificial Sequence
  oligonucleotide patterns over-represented in STAR elements
acaccc

SEQ ID NO: 345 - DNA, 6 bp, Artificial Sequence
  oligonucleotide patterns over-represented in STAR elements
agggcc

SEQ ID NO: 346 - DNA, 6 bp, Artificial Sequence
  oligonucleotide patterns over-represented in STAR elements
cgcgaa

SEQ ID NO: 347 - DNA, 6 bp, Artificial Sequence
  oligonucleotide patterns over-represented in STAR elements
gagccc

SEQ ID NO: 348 - DNA, 6 bp, Artificial Sequence
  oligonucleotide patterns over-represented in STAR elements
ctgagc

SEQ ID NO: 349 - DNA, 6 bp, Artificial Sequence
  oligonucleotide patterns over-represented in STAR elements
aatcgg

SEQ ID NO: 350 - DNA, 8 bp, Artificial Sequence
  Dyad patterns over-represented in STAR elements
  misc_feature (4)..(5): the `n' at positions 4-5 may be any nucleic acid
cccnncgg

SEQ ID NO: 351 - DNA, 12 bp, Artificial Sequence
  Dyad patterns over-represented in STAR elements
  misc_feature (4)..(9): the `n' at positions 4-9 may be any nucleic acid
ccgnnnnnnccc

SEQ ID NO: 352 - DNA, 6 bp, Artificial Sequence
  Dyad patterns over-represented in STAR elements
cagcgg

SEQ ID NO: 353 - DNA, 21 bp, Artificial Sequence
  Dyad patterns over-represented in STAR elements
  misc_feature (4)..(18): the `n' at positions 4-18 may be any nucleic acid
cgcnnnnnnnnnnnnnnnccc

SEQ ID NO: 354 - DNA, 15 bp, Artificial Sequence
  Dyad patterns over-represented in STAR elements
  misc_feature (4)..(12): the `n' at positions 4-12 may be any nucleic acid
cggnnnnnnnnngcc

SEQ ID NO: 355 - DNA, 15 bp, Artificial Sequence
  Dyad patterns over-represented in STAR elements
  misc_feature (4)..(12): the `n' at positions 4-12 may be any nucleic acid
cccnnnnnnnnncgc

SEQ ID NO: 356 - DNA, 7 bp, Artificial Sequence
  Dyad patterns over-represented in STAR elements
  misc_feature (4)..(4): the `n' at position 4 may be any nucleic acid
cccngcg

SEQ ID NO: 357 - DNA, 6 bp, Artificial Sequence
  Dyad patterns over-represented in STAR elements
ccccac

SEQ ID NO: 358 - DNA, 22 bp, Artificial Sequence
  Dyad patterns over-represented in STAR elements
  misc_feature (4)..(19): the `n' at positions 4-19 may be any nucleic acid
agcnnnnnnnnnnnnnnnnccg

SEQ ID NO: 359 - DNA, 10 bp, Artificial Sequence
  Dyad patterns over-represented in STAR elements
  misc_feature (4)..(7): the `n' at positions 4-7 may be any nucleic acid
cccnnnncgc

SEQ ID NO: 360 - DNA, 19 bp, Artificial Sequence
  Dyad patterns over-represented in STAR elements
  misc_feature (4)..(16): the `n' at positions 4-16 may be any nucleic acid
cgcnnnnnnnnnnnnngga

SEQ ID NO: 361 - DNA, 22 bp, Artificial Sequence
  Dyad patterns over-represented in STAR elements
  misc_feature (4)..(19): the `n' at positions 4-19 may be any nucleic acid
gcgnnnnnnnnnnnnnnnnccc

SEQ ID NO: 362 - DNA, 11 bp, Artificial Sequence
  Dyad patterns over-represented in STAR elements
  misc_feature (4)..(8): the `n' at positions 4-8 may be any nucleic acid
cgcnnnnngca

SEQ ID NO: 363 - DNA, 20 bp, Artificial Sequence
  Dyad patterns over-represented in STAR elements
  misc_feature (4)..(17): the `n' at positions 4-9 may be any nucleic acid
cccnnnnnnnnnnnnnnccc

SEQ ID NO: 364 - DNA, 10 bp, Artificial Sequence
  Dyad patterns over-represented in STAR elements
  misc_feature (4)..(7): the `n' at positions 4-7 may be any nucleic acid
ctgnnnncgc

SEQ ID NO: 365 - DNA, 18 bp, Artificial Sequence
  Dyad patterns over-represented in STAR elements
  misc_feature (4)..(15): the `n' at positions 4-15 may be any nucleic acid
ccannnnnnnnnnnngcg

SEQ ID NO: 366 - DNA, 17 bp, Artificial Sequence
  Dyad patterns over-represented in STAR elements
  misc_feature (4)..(14): the `n' at positions 4-14 may be any nucleic acid
cggnnnnnnnnnnncag

SEQ ID NO: 367 - DNA, 11 bp, Artificial Sequence
  Dyad patterns over-represented in STAR elements
  misc_feature (4)..(8): the `n' at positions 4-8 may be any nucleic acid
cccnnnnngcc

SEQ ID NO: 368 - DNA, 6 bp, Artificial Sequence
  Dyad patterns over-represented in STAR elements
gccccc

SEQ ID NO: 369 - DNA, 10 bp, Artificial Sequence
  Dyad patterns over-represented in STAR elements
  misc_feature (4)..(7): the `n' at positions 4-7 may be any nucleic acid
cgcnnnngac

SEQ ID NO: 370 - DNA, 6 bp, Artificial Sequence
  Dyad patterns over-represented in STAR elements
cggcag

SEQ ID NO: 371 - DNA, 9 bp, Artificial Sequence
  Dyad patterns over-represented in STAR elements
  misc_feature (4)..(6): the `n' at positions 4-6 may be any nucleic acid
cccnnncgc

SEQ ID NO: 372 - DNA, 7 bp, Artificial Sequence
  Dyad patterns over-represented in STAR elements
  misc_feature (4)..(4): the `n' at position 4 may be any nucleic acid
cgcngac

SEQ ID NO: 373 - DNA, 8 bp, Artificial Sequence
  Dyad patterns over-represented in STAR elements
  misc_feature (4)..(5): the `n' at positions 4-5 may be any nucleic acid
gcgnngcc

SEQ ID NO: 374 - DNA, 10 bp, Artificial Sequence
  Dyad patterns over-represented in STAR elements
  misc_feature (4)..(7): the `n' at positions 4-7 may be any nucleic acid
cccnnnngcc

SEQ ID NO: 375 - DNA, 7 bp, Artificial Sequence
  Dyad patterns over-represented in STAR elements
  misc_feature (4)..(4): the `n' at position 4 may be any nucleic acid
cccnccc

SEQ ID NO: 376 - DNA, 19 bp, Artificial Sequence
  Dyad patterns over-represented in STAR elements
  misc_feature (4)..(16): the `n' at positions 4-16 may be any nucleic acid
ccgnnnnnnnnnnnnncag

SEQ ID NO: 377 - DNA, 10 bp, Artificial Sequence
  Dyad patterns over-represented in STAR elements
  misc_feature (4)..(7): the `n' at positions 4-9 may be any nucleic acid
gccnnnngga

SEQ ID NO: 378 - DNA, 9 bp, Artificial Sequence
  Dyad patterns over-represented in STAR elements
  misc_feature (4)..(6): the `n' at positions 4-6 may be any nucleic acid
ccgnnngga

SEQ ID NO: 379 - DNA, 8 bp, Artificial Sequence
  Dyad patterns over-represented in STAR elements
  misc_feature (4)..(5): the `n' at positions 4-9 may be any nucleic acid
aggnnggg

SEQ ID NO: 380 - DNA, 11 bp, Artificial Sequence
  Dyad patterns over-represented in STAR elements
  misc_feature (4)..(8): the `n' at positions 4-8 may be any nucleic acid
cacnnnnngcg

SEQ ID NO: 381 - DNA, 23 bp, Artificial Sequence
  Dyad patterns over-represented in STAR elements
  misc_feature (4)..(20): the `n' at positions 4-20 may be any nucleic acid
cgcnnnnnnnnnnnnnnnnncca

SEQ ID NO: 382 - DNA, 15 bp, Artificial Sequence
  Dyad patterns over-represented in STAR elements
  misc_feature (4)..(12): the `n' at positions 4-12 may be any nucleic acid
cccnnnnnnnnnggc

SEQ ID NO: 383 - DNA, 11 bp, Artificial Sequence
  Dyad patterns over-represented in STAR elements
  misc_feature (4)..(8): the `n' at positions 4-8 may be any nucleic acid
cctnnnnngcg

SEQ ID NO: 384 - DNA, 6 bp, Artificial Sequence
  Dyad patterns over-represented in STAR elements
gcggac

SEQ ID NO: 385 - DNA, 6 bp, Artificial Sequence
  Dyad patterns over-represented in STAR elements
gccggc

SEQ ID NO: 386 - DNA, 8 bp, Artificial Sequence
  Dyad patterns over-represented in STAR elements
  misc_feature (4)..(5): the `n' at positions 4-5 may be any nucleic acid
gcgnnccc

SEQ ID NO: 387 - DNA, 17 bp, Artificial Sequence
  Dyad patterns over-represented in STAR elements
  misc_feature (4)..(14): the `n' at positions 4-14 may be any nucleic acid
ccgnnnnnnnnnnnccc

SEQ ID NO: 388 - DNA, 14 bp, Artificial Sequence
  Dyad patterns over-represented in STAR elements
  misc_feature (4)..(11): the `n' at positions 4-11 may be any nucleic acid
cccnnnnnnnntcg

SEQ ID NO: 389 - DNA, 23 bp, Artificial Sequence
  Dyad patterns over-represented in STAR elements
  misc_feature (4)..(20): the `n' at positions 4-20 may be any nucleic acid
ccgnnnnnnnnnnnnnnnnngcc

SEQ ID NO: 390 - DNA, 11 bp, Artificial Sequence
  Dyad patterns over-represented in STAR elements
  misc_feature (4)..(8): the `n' at positions 4-8 may be any nucleic acid
gggnnnnngga

SEQ ID NO: 391 - DNA, 12 bp, Artificial Sequence
  Dyad patterns over-represented in STAR elements
  misc_feature (4)..(9): the `n' at positions 4-9 may be any nucleic acid
ggcnnnnnngga

SEQ ID NO: 392 - DNA, 10 bp, Artificial Sequence
  Dyad patterns over-represented in STAR elements
  misc_feature (4)..(7): the `n' at positions 4-7 may be any nucleic acid
ccannnnccc

SEQ ID NO: 393 - DNA, 20 bp, Artificial Sequence
  Dyad patterns over-represented in STAR elements
  misc_feature (4)..(17): the `n' at positions 4-17 may be any nucleic acid
cctnnnnnnnnnnnnnnccg

SEQ ID NO: 394 - DNA, 18 bp, Artificial Sequence
  Dyad patterns over-represented in STAR elements
  misc_feature (4)..(15): the `n' at positions 4-15 may be any nucleic acid
gacnnnnnnnnnnnnggc

SEQ ID NO: 395 - DNA, 19 bp, Artificial Sequence
  Dyad patterns over-represented in STAR elements
  misc_feature (4)..(16): " the `n' at positions 4-16 may be any nucleic acid
cgcnnnnnnnnnnnnnccc

SEQ ID NO: 396 - DNA, 22 bp, Artificial Sequence
  Dyad patterns over-represented in STAR elements
  misc_feature (4)..(19): the `n' at positions 4-19 may be any nucleic acid
cagnnnnnnnnnnnnnnnnccc

SEQ ID NO: 397 - DNA, 16 bp, Artificial Sequence
  Dyad patterns over-represented in STAR elements
  misc_feature (4)..(13): the `n' at positions 4-13 may be any nucleic acid
agcnnnnnnnnnnggg

SEQ ID NO: 398 - DNA, 19 bp, Artificial Sequence
  Dyad patterns over-represented in STAR elements
  misc_feature (4)..(16): the `n' at positions 4-16 may be any nucleic acid
cggnnnnnnnnnnnnnggc

SEQ ID NO: 399 - DNA, 7 bp, Artificial Sequence
  Dyad patterns over-represented in STAR elements
  misc_feature (4)..(4): the `n' at position 4 may be any nucleic acid
cggngcc

SEQ ID NO: 400 - DNA, 6 bp, Artificial Sequence
  Dyad patterns over-represented in STAR elements
agcggc

SEQ ID NO: 401 - DNA, 22 bp, Artificial Sequence
  Dyad patterns over-represented in STAR elements
  misc_feature (4)..(19): the `n' at positions 4-19 may be any nucleic acid
cccnnnnnnnnnnnnnnnnggc

SEQ ID NO: 402 - DNA, 25 bp, Artificial Sequence
  Dyad patterns over-represented in STAR elements
  misc_feature (4)..(22): the `n' at positions 4-22 may be any nucleic acid
gctnnnnnnnnnnnnnnnnnnnccc

SEQ ID NO: 403 - DNA, 22 bp, Artificial Sequence
  Dyad patterns over-represented in STAR elements
  misc_feature (4)..(19): "N" stands for any nucleic acid
cccnnnnnnnnnnnnnnnnggg

SEQ ID NO: 404 - DNA, 15 bp, Artificial Sequence
  Dyad patterns over-represented in STAR elements
  misc_feature (4)..(12): the `n' at positions 4-12 may be any nucleic acid
cccnnnnnnnnncgg

SEQ ID NO: 405 - DNA, 16 bp, Artificial Sequence
  Dyad patterns over-represented in STAR elements
  misc_feature (4)..(13): the `n' at positions 4-13 may be any nucleic acid
cccnnnnnnnnnncgg

SEQ ID NO: 406 - DNA, 6 bp, Artificial Sequence
  Dyad patterns over-represented in STAR elements
ccagcg

SEQ ID NO: 407 - DNA, 23 bp, Artificial Sequence
  Dyad patterns over-represented in STAR elements
  misc_feature (4)..(20): the `n' at positions 4-20 may be any nucleic acid
gccnnnnnnnnnnnnnnnnncgc

SEQ ID NO: 408 - DNA, 12 bp, Artificial Sequence
  Dyad patterns over-represented in STAR elements
  misc_feature (4)..(9): the `n' at positions 4-9 may be any nucleic acid
cctnnnnnncgc

SEQ ID NO: 409 - DNA, 7 bp, Artificial Sequence
  Dyad patterns over-represented in STAR elements
  misc_feature (4)..(4): the `n' at position 4 may be any nucleic acid
gganccc

SEQ ID NO: 410 - DNA, 24 bp, Artificial Sequence
  Dyad patterns over-represented in STAR elements
  misc_feature (4)..(21): the `n' at positions 4-21 may be any nucleic acid
cgcnnnnnnnnnnnnnnnnnncac

SEQ ID NO: 411 - DNA, 26 bp, Artificial Sequence
  Dyad patterns over-represented in STAR elements
  misc_feature (4)..(23): the `n' at positions 4-23 may be any nucleic acid
cgcnnnnnnnnnnnnnnnnnnnnccg

SEQ ID NO: 412 - DNA, 6 bp, Artificial Sequence
  Dyad patterns over-represented in STAR elements
ccggca

SEQ ID NO: 413 - DNA, 26 bp, Artificial Sequence
  Dyad patterns over-represented in STAR elements
  misc_feature (4)..(23): the `n' at positions 4-23 may be any nucleic acid
cgcnnnnnnnnnnnnnnnnnnnnccc

SEQ ID NO: 414 - DNA, 21 bp, Artificial Sequence
  Dyad patterns over-represented in STAR elements
  misc_feature (4)..(18): the `n' at positions 4-18 may be any nucleic acid
agcnnnnnnnnnnnnnnnccc

SEQ ID NO: 415 - DNA, 13 bp, Artificial Sequence
  Dyad patterns over-represented in STAR elements
  misc_feature (4)..(10): the `n' at positions 4-10 may be any nucleic acid
cctnnnnnnnggc

SEQ ID NO: 416 - DNA, 11 bp, Artificial Sequence
  Dyad patterns over-represented in STAR elements
  misc_feature (4)..(8): the `n' at positions 4-8 may be any nucleic acid
gccnnnnncgc

SEQ ID NO: 417 - DNA, 20 bp, Artificial Sequence
  Dyad patterns over-represented in STAR elements
  misc_feature (4)..(17): the `n' at positions 4-17 may be any nucleic acid
gccnnnnnnnnnnnnnncgc

SEQ ID NO: 418 - DNA, 17 bp, Artificial Sequence
  Dyad patterns over-represented in STAR elements
  misc_feature (4)..(14): the `n' at positions 4-14 may be any nucleic acid
cagnnnnnnnnnnnccc

SEQ ID NO: 419 - DNA, 22 bp, Artificial Sequence
  Dyad patterns over-represented in STAR elements
  misc_feature (4)..(19): the `n' at positions 4-19 may be any nucleic acid
gggnnnnnnnnnnnnnnnngac

SEQ ID NO: 420 - DNA, 21 bp, Artificial Sequence
  Dyad patterns over-represented in STAR elements
  misc_feature (4)..(18): the `n' at positions 4-18 may be any nucleic acid
cccnnnnnnnnnnnnnnngcg

SEQ ID NO: 421 - DNA, 6 bp, Artificial Sequence
  Dyad patterns over-represented in STAR elements
ccccgc

SEQ ID NO: 422 - DNA, 22 bp, Artificial Sequence
  Dyad patterns over-represented in STAR elements
  misc_feature (4)..(19): the `n' at positions 4-19 may be any nucleic acid
cccnnnnnnnnnnnnnnnnagc

SEQ ID NO: 423 - DNA, 15 bp, Artificial Sequence
  Dyad patterns over-represented in STAR elements
  misc_feature (4)..(12): the `n' at positions 4-12 may be any nucleic acid
aggnnnnnnnnnggg

SEQ ID NO: 424 - DNA, 18 bp, Artificial Sequence
  Dyad patterns over-represented in STAR elements
  misc_feature (4)..(18): the `n' at positions 4-18 may be any nucleic acid
cgcnnnnnnnnnnnnctc

SEQ ID NO: 425 - DNA, 14 bp, Artificial Sequence
  Dyad patterns over-represented in STAR elements
  misc_feature (4)..(11): "N" stands for any nucleic acid
cacnnnnnnnncgc

SEQ ID NO: 426 - DNA, 13 bp, Artificial Sequence
  Dyad patterns over-represented in STAR elements
  misc_feature (4)..(10): "N" stands for any nucleic acid
ccannnnnnnccg

SEQ ID NO: 427 - DNA, 7 bp, Artificial Sequence
  Dyad patterns over-represented in STAR elements
  misc_feature (4)..(4): the `n' at position 4 may be any nucleic acid
cggngca

SEQ ID NO: 428 - DNA, 20 bp, Artificial Sequence
  Dyad patterns over-represented in STAR elements
  misc_feature (4)..(17): the `n' at positions 4-17 may be any nucleic acid
cgcnnnnnnnnnnnnnnccc

SEQ ID NO: 429 - DNA, 6 bp, Artificial Sequence
  Dyad patterns over-represented in STAR elements
agcccc

SEQ ID NO: 430 - DNA, 19 bp, Artificial Sequence
  Dyad patterns over-represented in STAR elements
  misc_feature (4)..(16): the `n' at positions 4-16 may be any nucleic acid
cgcnnnnnnnnnnnnngtc

SEQ ID NO: 431 - DNA, 9 bp, Artificial Sequence
  Dyad patterns over-represented in STAR elements
  misc_feature (4)..(6): "N" stands for any nucleic acid
gcgnnngca

SEQ ID NO: 432 - DNA, 6 bp, Artificial Sequence
  Dyad patterns over-represented in STAR elements
cggggc

SEQ ID NO: 433 - DNA, 20 bp, Artificial Sequence
  Dyad patterns over-represented in STAR elements
  misc_feature (4)..(17): "n" stands for any nucleic acid
gccnnnnnnnnnnnnnnccc

SEQ ID NO: 434 - DNA, 13 bp, Artificial Sequence
  Dyad patterns over-represented in STAR elements
  misc_feature (4)..(10): the `n' at positions 4-10 may be any nucleic acid
accnnnnnnncgc

SEQ ID NO: 435 - DNA, 13 bp, Artificial Sequence
  Dyad patterns over-represented in STAR elements
  misc_feature (4)..(10): the `n' at positions 4-10 may be any nucleic acid
aggnnnnnnncgg

SEQ ID NO: 436 - DNA, 22 bp, Artificial Sequence
  Dyad patterns over-represented in STAR elements
  misc_feature (4)..(19): the `n' at positions 4-19 may be any nucleic acid
cccnnnnnnnnnnnnnnnncga

SEQ ID NO: 437 - DNA, 12 bp, Artificial Sequence
  Dyad patterns over-represented in STAR elements
  misc_feature (4)..(9): the `n' at positions 4-9 may be any nucleic acid
cgcnnnnnncag

SEQ ID NO: 438 - DNA, 17 bp, Artificial Sequence
  Dyad patterns over-represented in STAR elements
  misc_feature (4)..(14): the `n' at positions 4-14 may be any nucleic acid
cagnnnnnnnnnnngcg

SEQ ID NO: 439 - DNA, 18 bp, Artificial Sequence
  Dyad patterns over-represented in STAR elements
  misc_feature (4)..(15): "N" stands for any nucleic acid
ccgnnnnnnnnnnnnccg

SEQ ID NO: 440 - DNA, 24 bp, Artificial Sequence
  Dyad patterns over-represented in STAR elements
  misc_feature (4)..(21): the `n' at positions 4-21 may be any nucleic acid
cgcnnnnnnnnnnnnnnnnnncag

SEQ ID NO: 441 - DNA, 7 bp, Artificial Sequence
  Dyad patterns over-represented in STAR elements
  misc_feature (4)..(4): "N" stands for any nucleic acid
cagnggg

SEQ ID NO: 442 - DNA, 6 bp, Artificial Sequence
  Dyad patterns over-represented in STAR elements
cgcccc

SEQ ID NO: 443 - DNA, 24 bp, Artificial Sequence
  Dyad patterns over-represented in STAR elements
  misc_feature (4)..(21): the `n' at positions 4-21 may be any nucleic acid
gcgnnnnnnnnnnnnnnnnnngcc

SEQ ID NO: 444 - DNA, 21 bp, Artificial Sequence
  Dyad patterns over-represented in STAR elements
  misc_feature (4)..(18): "N" stands for any nucleic acid
cggnnnnnnnnnnnnnnnggc

SEQ ID NO: 445 - DNA, 21 bp, Artificial Sequence
  Dyad patterns over-represented in STAR elements
  misc_feature (4)..(18): the `n' at positions 4-18 may be any nucleic acid
cccnnnnnnnnnnnnnnnagg

SEQ ID NO: 446 - DNA, 26 bp, Artificial Sequence
  Dyad patterns over-represented in STAR elements
  misc_feature (4)..(23): the `n' at positions 4-23 may be any nucleic acid
aggnnnnnnnnnnnnnnnnnnnngcg

SEQ ID NO: 447 - DNA, 11 bp, Artificial Sequence
  Dyad patterns over-represented in STAR elements
  misc_feature (4)..(8): the `n' at positions 4-8 may be any nucleic acid
cggnnnnnctc

SEQ ID NO: 448 - DNA, 23 bp, Artificial Sequence
  Dyad patterns over-represented in STAR elements
  misc_feature (4)..(20): the `n' at positions 4-20 may be any nucleic acid
tccnnnnnnnnnnnnnnnnncga

SEQ ID NO: 449 - DNA, 10 bp, Artificial Sequence
  Dyad patterns over-represented in STAR elements
  misc_feature (4)..(7): the `n' at positions 4-7 may be any nucleic acid
gcgnnnnccc

SEQ ID NO: 450 - DNA, 8 bp, Artificial Sequence
  Dyad patterns over-represented in STAR elements
  misc_feature (4)..(5): the `n' at positions 4-5 may be any nucleic acid
cccnncgc

SEQ ID NO: 451 - DNA, 9 bp, Artificial Sequence
  Dyad patterns over-represented in STAR elements
  misc_feature (4)..(6): the `n' at positions 4-6 may be any nucleic acid
cgtnnncag

SEQ ID NO: 452 - DNA, 19 bp, Artificial Sequence
  Dyad patterns over-represented in STAR elements
  misc_feature (4)..(16): the `n' at positions 4-16 may be any nucleic acid
ccgnnnnnnnnnnnnngag

SEQ ID NO: 453 - DNA, 12 bp, Artificial Sequence
  Dyad patterns over-represented in STAR elements
  misc_feature (4)..(9): the `n' at positions 4-9 may be any nucleic acid
ctcnnnnnncgc

SEQ ID NO: 454 - DNA, 10 bp, Artificial Sequence
  Dyad patterns over-represented in STAR elements
  misc_feature (4)..(7): the `n' at positions 4-7 may be any nucleic acid
cgcnnnngag

SEQ ID NO: 455 - DNA, 11 bp, Artificial Sequence
  Dyad patterns over-represented in STAR elements
  misc_feature (4)..(8): the `n' at positions 4-8 may be any nucleic acid
gcgnnnnngga

SEQ ID NO: 456 - DNA, 7 bp, Artificial Sequence
  Dyad patterns over-represented in STAR elements
  misc_feature (4)..(4): the `n' at position 4 may be any nucleic acid
ccgncag

SEQ ID NO: 457 - DNA, 17 bp, Artificial Sequence
  Dyad patterns over-represented in STAR elements
  misc_feature (4)..(14): the `n' at positions 4-14 may be any nucleic acid
cgcnnnnnnnnnnnccg

SEQ ID NO: 458 - DNA, 25 bp, Artificial Sequence
  Dyad patterns over-represented in STAR elements
  misc_feature (4)..(22): the `n' at positions 4-22 may be any nucleic acid
gcgnnnnnnnnnnnnnnnnnnnccc

SEQ ID NO: 459 - DNA, 24 bp, Artificial Sequence
  Dyad patterns over-represented in STAR elements
  misc_feature (4)..(21): the `n' at positions 4-21 may be any nucleic acid
cgcnnnnnnnnnnnnnnnnnngaa

SEQ ID NO: 460 - DNA, 25 bp, Artificial Sequence
  Dyad patterns over-represented in STAR elements
  misc_feature (4)..(22): the `n' at positions 4-22 may be any nucleic acid
gggnnnnnnnnnnnnnnnnnnngga

SEQ ID NO: 461 - DNA, 7 bp, Artificial Sequence
  Dyad patterns over-represented in STAR elements
  misc_feature (4)..(4): the `n' at position 4 may be any nucleic acid
ccancgg

SEQ ID NO: 462 - DNA, 13 bp, Artificial Sequence
  Dyad patterns over-represented in STAR elements
  misc_feature (4)..(10): the `n' at positions 4-10 may be any nucleic acid
cccnnnnnnngcg

SEQ ID NO: 463 - DNA, 16 bp, Artificial Sequence
  Dyad patterns over-represented in STAR elements
  misc_feature (4)..(13): the `n' at positions 4-13 may be any nucleic acid
aggnnnnnnnnnnccc

SEQ ID NO: 464 - DNA, 6 bp, Artificial Sequence
  Dyad patterns over-represented in STAR elements
ccaggg

SEQ ID NO: 465 - DNA, 16 bp, Artificial Sequence
  Dyad patterns over-represented in STAR elements
  misc_feature (4)..(13): the `n' at positions 4-13 may be any nucleic acid
cagnnnnnnnnnnccc

SEQ ID NO: 466 - DNA, 24 bp, Artificial Sequence
  Dyad patterns over-represented in STAR elements
  misc_feature (4)..(21): the `n' at positions 4-21 may be any nucleic acid
ccgnnnnnnnnnnnnnnnnnnccg

SEQ ID NO: 467 - DNA, 24 bp, Artificial Sequence
  Dyad patterns over-represented in STAR elements
  misc_feature (4)..(21): the `n' at positions 4-21 may be any nucleic acid
ccgnnnnnnnnnnnnnnnnnnggc

SEQ ID NO: 468 - DNA, 8 bp, Artificial Sequence
  Dyad patterns over-represented in STAR elements
  misc_feature (4)..(5): the `n' at positions 4-5 may be any nucleic acid
cccnngcg

SEQ ID NO: 469 - DNA, 7 bp, Artificial Sequence
  Dyad patterns over-represented in STAR elements
  misc_feature (4)..(5): the `n' at positions 4-5 may be any nucleic acid
cgcnggc

SEQ ID NO: 470 - DNA, 11 bp, Artificial Sequence
  Dyad patterns over-represented in STAR elements
  misc_feature (4)..(8): the `n' at positions 4-8 may be any nucleic acid
ccgnnnnngac

SEQ ID NO: 471 - DNA, 6 bp, Artificial Sequence
  Dyad patterns over-represented in STAR elements
ggaccc

SEQ ID NO: 472 - DNA, 7 bp, Artificial Sequence
  Dyad patterns over-represented in STAR elements
  misc_feature (4)..(4): the `n' at position 4 may be any nucleic acid
cccnccg

SEQ ID NO: 473 - DNA, 21 bp, Artificial Sequence
  Dyad patterns over-represented in STAR elements
  misc_feature (4)..(18): "N" stands for any nucleic acid
cccnnnnnnnnnnnnnnnacg

SEQ ID NO: 474 - DNA, 14 bp, Artificial Sequence
  Dyad patterns over-represented in STAR elements
  misc_feature (4)..(11): the `n' at positions 4-11 may be any nucleic acid
agcnnnnnnnnccc

SEQ ID NO: 475 - DNA, 9 bp, Artificial Sequence
  Dyad patterns over-represented in STAR elements
  misc_feature (4)..(6): the `n' at positions 4-6 may be any nucleic acid
cccnnnggc

SEQ ID NO: 476 - DNA, 15 bp, Artificial Sequence
  Dyad patterns over-represented in STAR elements
  misc_feature (4)..(12): the `n' at positions 4-12 may be any nucleic acid
aggnnnnnnnnncgg

SEQ ID NO: 477 - DNA, 20 bp, Artificial Sequence
  Dyad patterns over-represented in STAR elements
  misc_feature (4)..(17): the `n' at positions 4-17 may be any nucleic acid
cccnnnnnnnnnnnnnncgc

SEQ ID NO: 478 - DNA, 6 bp, Artificial Sequence
  Dyad patterns over-represented in STAR elements
ccgccg

SEQ ID NO: 479 - DNA, 14 bp, Artificial Sequence
  Dyad patterns over-represented in STAR elements
  misc_feature (4)..(11): the `n' at positions 4-11 may be any nucleic acid
cgcnnnnnnnnagc

SEQ ID NO: 480 - DNA, 25 bp, Artificial Sequence
  Dyad patterns over-represented in STAR elements
  misc_feature (4)..(22): the `n' at positions 4-22 may be any nucleic acid
cgcnnnnnnnnnnnnnnnnnnnacc

SEQ ID NO: 481 - DNA, 23 bp, Artificial Sequence
  Dyad patterns over-represented in STAR elements
  misc_feature (4)..(20): the `n' at positions 4-20 may be any nucleic acid
gcgnnnnnnnnnnnnnnnnngac

SEQ ID NO: 482 - DNA, 7 bp, Artificial Sequence
  Dyad patterns over-represented in STAR elements
  misc_feature (4)..(4): the `n' at position 4 may be any nucleic acid
agcngcg

SEQ ID NO: 483 - DNA, 17 bp, Artificial Sequence
  Dyad patterns over-represented in STAR elements
  misc_feature (4)..(14): the `n' at positions 4-14 may be any nucleic acid
ccgnnnnnnnnnnnggc

SEQ ID NO: 484 - DNA, 10 bp, Artificial Sequence
  Dyad patterns over-represented in STAR elements
  misc_feature (4)..(7): the `n' at positions 4-7 may be any nucleic acid
cggnnnnaga

SEQ ID NO: 485 - DNA, 20 bp, Artificial Sequence
  Dyad patterns over-represented in STAR elements
  misc_feature (4)..(17): the `n' at positions 4-17 may be any nucleic acid
cgcnnnnnnnnnnnnnnccg

SEQ ID NO: 486 - DNA, 26 bp, Artificial Sequence
  Dyad patterns over-represented in STAR elements
  misc_feature (4)..(23): the `n' at positions 4-23 may be any nucleic acid
cctnnnnnnnnnnnnnnnnnnnngcg

SEQ ID NO: 487 - DNA, 16 bp, Artificial Sequence
  Dyad patterns over-represented in STAR elements
  misc_feature (4)..(13): the `n' at positions 4-13 may be any nucleic acid
ccannnnnnnnnncgc

SEQ ID NO: 488 - DNA, 26 bp, Artificial Sequence
  Dyad patterns over-represented in STAR elements
  misc_feature (4)..(23): the `n' at positions 4-23 may be any nucleic acid
cccnnnnnnnnnnnnnnnnnnnncac

SEQ ID NO: 489 - DNA, 17 bp, Artificial Sequence
  Dyad patterns over-represented in STAR elements
  misc_feature (4)..(14): the `n' at positions 4-14 may be any nucleic acid
ccgnnnnnnnnnnngcc

SEQ ID NO: 490 - DNA, 24 bp, Artificial Sequence
  Dyad patterns over-represented in STAR elements
  misc_feature (4)..(21): "N" stands for any nucleic acid
cgcnnnnnnnnnnnnnnnnnnccc

SEQ ID NO: 491 - DNA, 21 bp, Artificial Sequence
  Dyad patterns over-represented in STAR elements
  misc_feature (4)..(18): the `n' at positions 4-18 may be any nucleic acid
cggnnnnnnnnnnnnnnncgc

SEQ ID NO: 492 - DNA, 22 bp, Artificial Sequence
  Dyad patterns over-represented in STAR elements
  misc_feature (4)..(19): the `n' at positions 4-19 may be any nucleic acid
cgcnnnnnnnnnnnnnnnngcc

SEQ ID NO: 493 - DNA, 26 bp, Artificial Sequence
  Dyad patterns over-represented in STAR elements
  misc_feature (4)..(23): the `n' at positions 4-23 may be any nucleic acid
cgcnnnnnnnnnnnnnnnnnnnnggc

SEQ ID NO: 494 - DNA, 25 bp, Artificial Sequence
  Dyad patterns over-represented in STAR elements
  misc_feature (4)..(22): the `n' at positions 4-22 may be any nucleic acid
cgcnnnnnnnnnnnnnnnnnnnccg

SEQ ID NO: 495 - DNA, 16 bp, Artificial Sequence
  Dyad patterns over-represented in STAR elements
  misc_feature (4)..(13): the `n' at positions 4-13 may be any nucleic acid
cggnnnnnnnnnncca

SEQ ID NO: 496 - DNA, 23 bp, Artificial Sequence
  Dyad patterns over-represented in STAR elements
  misc_feature (4)..(20): the `n' at positions 4-20 may be any nucleic acid
cgcnnnnnnnnnnnnnnnnnccc

SEQ ID NO: 497 - DNA, 17 bp, Artificial Sequence
  Dyad patterns over-represented in STAR elements
  misc_feature (4)..(14): the `n' at positions 4-14 may be any nucleic acid
cgcnnnnnnnnnnnaca

SEQ ID NO: 498 - DNA, 6 bp, Artificial Sequence
  Dyad patterns over-represented in STAR elements
cggacc

SEQ ID NO: 499 - DNA, 16 bp, Artificial Sequence
  Dyad patterns over-represented in STAR elements
  misc_feature (4)..(13): the `n' at positions 4-13 may be any nucleic acid
gcgnnnnnnnnnngcc

SEQ ID NO: 500 - DNA, 14 bp, Artificial Sequence
  Dyad patterns over-represented in STAR elements
  misc_feature (4)..(11): the `n' at positions 4-11 may be any nucleic acid
gcgnnnnnnnngac

SEQ ID NO: 501 - DNA, 21 bp, Artificial Sequence
  Dyad patterns over-represented in STAR elements
  misc_feature (4)..(18): the `n' at positions 4-18 may be any nucleic acid
cccnnnnnnnnnnnnnnnggg

SEQ ID NO: 502 - DNA, 22 bp, Artificial Sequence
  Dyad patterns over-represented in STAR elements
  misc_feature (4)..(19): the `n' at positions 4-19 may be any nucleic acid
cggnnnnnnnnnnnnnnnnggc

SEQ ID NO: 503 - DNA, 22 bp, Artificial Sequence
  Dyad patterns over-represented in STAR elements
  misc_feature (4)..(19): the `n' at positions 4-19 may be any nucleic acid
cgcnnnnnnnnnnnnnnnncca

SEQ ID NO: 504 - DNA, 9 bp, Artificial Sequence
  Dyad patterns over-represented in STAR elements
  misc_feature (4)..(6): the `n' at positions 4-6 may be any nucleic acid
gccnnnccc

SEQ ID NO: 505 - DNA, 10 bp, Artificial Sequence
  Dyad patterns over-represented in STAR elements
  misc_feature (4)..(7): the `n' at positions 4-7 may be any nucleic acid
cagnnnnggg

SEQ ID NO: 506 - DNA, 12 bp, Artificial Sequence
  Dyad patterns over-represented in STAR elements
  misc_feature (4)..(9): the `n' at positions 4-9 may be any nucleic acid
cccnnnnnngcg

SEQ ID NO: 507 - DNA, 22 bp, Artificial Sequence
  Dyad patterns over-represented in STAR elements
  misc_feature (4)..(19): the `n' at positions 4-19 may be any nucleic acid
ccgnnnnnnnnnnnnnnnncgc

SEQ ID NO: 508 - DNA, 23 bp, Artificial Sequence
  Dyad patterns over-represented in STAR elements
  misc_feature (4)..(20): the `n' at positions 4-20 may be any nucleic acid
cccnnnnnnnnnnnnnnnnngca

SEQ ID NO: 509 - DNA, 19 bp, Artificial Sequence
  Dyad patterns over-represented in STAR elements
  misc_feature (4)..(16): the `n' at positions 4-16 may be any nucleic acid
cgcnnnnnnnnnnnnntcc

SEQ ID NO: 510 - DNA, 7 bp, Artificial Sequence
  Dyad patterns over-represented in STAR elements
  misc_feature (4)..(4): the `n' at position 4 may be any nucleic acid
gccncgc

SEQ ID NO: 511 - DNA, 25 bp, Artificial Sequence
  Dyad patterns over-represented in STAR elements
  misc_feature (4)..(22): the `n' at positions 4-22 may be any nucleic acid
ccgnnnnnnnnnnnnnnnnnnngag

SEQ ID NO: 512 - DNA, 16 bp, Artificial Sequence
  Dyad patterns over-represented in STAR elements
  misc_feature (4)..(13): the `n' at positions 4-11 may be any nucleic acid
gggnnnnnnnnnngga

SEQ ID NO: 513 - DNA, 11 bp, Artificial Sequence
  Dyad patterns over-represented in STAR elements
  misc_feature (4)..(8): the `n' at positions 4-8 may be any nucleic acid
cagnnnnnccg

SEQ ID NO: 514 - DNA, 9 bp, Artificial Sequence
  Dyad patterns over-represented in STAR elements
  misc_feature (4)..(6): the `n' at positions 4-6 may be any nucleic acid
cgcnnnaga

SEQ ID NO: 515 - DNA, 6 bp, Artificial Sequence
  Dyad patterns over-represented in STAR elements
gccgcc

SEQ ID NO: 516 - DNA, 14 bp, Artificial Sequence
  Dyad patterns over-represented in STAR elements
  misc_feature (4)..(11): the `n' at positions 4-11 may be any nucleic acid
cccnnnnnnnnggc

SEQ ID NO: 517 - DNA, 12 bp, Artificial Sequence
  Dyad patterns over-represented in STAR elements
  misc_feature (4)..(9): the `n' at positions 4-9 may be any nucleic acid
cctnnnnnngcg

SEQ ID NO: 518 - DNA, 12 bp, Artificial Sequence
  Dyad patterns over-represented in STAR elements
  misc_feature (4)..(9): the `n' at positions 4-9 may be any nucleic acid
gacnnnnnnccc

SEQ ID NO: 519 - DNA, 7 bp, Artificial Sequence
  Dyad patterns over-represented in STAR elements
  misc_feature (4)..(4): the `n' at position 4 may be any nucleic acid
cggnccc

SEQ ID NO: 520 - DNA, 21 bp, Artificial Sequence
  Dyad patterns over-represented in STAR elements
  misc_feature (4)..(18): the `n' at positions 4-18 may be any nucleic acid
cccnnnnnnnnnnnnnnnccg

SEQ ID NO: 521 - DNA, 15 bp, Artificial Sequence
  Dyad patterns over-represented in STAR elements
  misc_feature (4)..(12): the `n' at positions 4-12 may be any nucleic acid
cagnnnnnnnnnccc

SEQ ID NO: 522 - DNA, 16 bp, Artificial Sequence
  Dyad patterns over-represented in STAR elements
  misc_feature (4)..(13): the `n' at positions 4-13 may be any nucleic acid
cggnnnnnnnnnnggc

SEQ ID NO: 523 - DNA, 16 bp, Artificial Sequence
  Dyad patterns over-represented in STAR elements
  misc_feature (4)..(13): the `n' at positions 4-13 may be any nucleic acid
cgannnnnnnnnnacg

SEQ ID NO: 524 - DNA, 9 bp, Artificial Sequence
  Dyad patterns over-represented in STAR elements
  misc_feature (4)..(6): the `n' at positions 4-6 may be any nucleic acid
gcgnnntcc

SEQ ID NO: 525 - DNA, 9 bp, Artificial Sequence
  Dyad patterns over-represented in STAR elements
  misc_feature (4)..(6): the `n' at positions 4-6 may be any nucleic acid
cccnnngcc

SEQ ID NO: 526 - DNA, 7 bp, Artificial Sequence
  Dyad patterns over-represented in STAR elements
  misc_feature (4)..(4): the `n' at position 4 may be any nucleic acid
gcgnacc

SEQ ID NO: 527 - DNA, 15 bp, Artificial Sequence
  Dyad patterns over-represented in STAR elements
  misc_feature (4)..(12): the `n' at positions 4-12 may be any nucleic acid
ccgnnnnnnnnnagg

SEQ ID NO: 528 - DNA, 22 bp, Artificial Sequence
  Dyad patterns over-represented in STAR elements
  misc_feature (4)..(19): the `n' at positions 4-19 may be any nucleic acid
cgcnnnnnnnnnnnnnnnncag

SEQ ID NO: 529 - DNA, 6 bp, Artificial Sequence
  Dyad patterns over-represented in STAR elements
ggcccc

SEQ ID NO: 530 - DNA, 18 bp, Artificial Sequence
  Dyad patterns over-represented in STAR elements
  misc_feature (4)..(15): the `n' at positions 4-15 may be any nucleic acid
aggnnnnnnnnnnnnccg

SEQ ID NO: 531 - DNA, 6 bp, Artificial Sequence
  Dyad patterns over-represented in STAR elements
ccggcg

SEQ ID NO: 532 - DNA, 8 bp, Artificial Sequence
  Dyad patterns over-represented in STAR elements
  misc_feature (4)..(5): the `n' at positions 4-5 may be any nucleic acid
ccgnngcc

SEQ ID NO: 533 - DNA, 17 bp, Artificial Sequence
  Dyad patterns over-represented in STAR elements
  misc_feature (4)..(14): the `n' at positions 4-14 may be any nucleic acid
ccgnnnnnnnnnnngtc

SEQ ID NO: 534 - DNA, 6 bp, Artificial Sequence
  Dyad patterns over-represented in STAR elements
cagccc

SEQ ID NO: 535 - DNA, 11 bp, Artificial Sequence
  Dyad patterns over-represented in STAR elements
  misc_feature (4)..(8): the `n' at positions 4-8 may be any nucleic acid
cccnnnnnccg

SEQ ID NO: 536 - DNA, 26 bp, Artificial Sequence
  Dyad patterns over-represented in STAR elements
  misc_feature (4)..(23): the `n' at positions 4-23 may be any nucleic acid
gccnnnnnnnnnnnnnnnnnnnnccc

SEQ ID NO: 537 - DNA, 8 bp, Artificial Sequence
  Dyad patterns over-represented in STAR elements
  misc_feature (4)..(5): the `n' at positions 4-5 may be any nucleic acid
gacnncgc

SEQ ID NO: 538 - DNA, 12 bp, Artificial Sequence
  Dyad patterns over-represented in STAR elements
  misc_feature (4)..(9): the `n' at positions 4-9 may be any nucleic acid
cgcnnnnnncac

SEQ ID NO: 539 - DNA, 20 bp, Artificial Sequence
  Dyad patterns over-represented in STAR elements
  misc_feature (4)..(17): the `n' at positions 4-17 may be any nucleic acid
aggnnnnnnnnnnnnnngcg

SEQ ID NO: 540 - DNA, 11 bp, Artificial Sequence
  Dyad patterns over-represented in STAR elements
  misc_feature (4)..(8): the `n' at positions 4-8 may be any nucleic acid
gacnnnnncgc

SEQ ID NO: 541 - DNA, 25 bp, Artificial Sequence
  Dyad patterns over-represented in STAR elements
  misc_feature (4)..(22): the `n' at positions 4-22 may be any nucleic acid
cctnnnnnnnnnnnnnnnnnnnccg

SEQ ID NO: 542 - DNA, 18 bp, Artificial Sequence
  Dyad patterns over-represented in STAR elements
  misc_feature (4)..(15): the `n' at positions 4-15 may be any nucleic acid
ccgnnnnnnnnnnnngga

SEQ ID NO: 543 - DNA, 15 bp, Artificial Sequence
  Dyad patterns over-represented in STAR elements
  misc_feature (4)..(12): the `n' at positions 4-12 may be any nucleic acid
ggcnnnnnnnnngac

SEQ ID NO: 544 - DNA, 16 bp, Artificial Sequence
  Dyad patterns over-represented in STAR elements
  misc_feature (4)..(13): the `n' at positions 4-13 may be any nucleic acid
aggnnnnnnnnnnggg

SEQ ID NO: 545 - DNA, 16 bp, Artificial Sequence
  Dyad patterns over-represented in STAR elements
  misc_feature (4)..(13): the `n' at positions 4-13 may be any nucleic acid
ccgnnnnnnnnnngag

SEQ ID NO: 546 - DNA, 12 bp, Artificial Sequence
  Dyad patterns over-represented in STAR elements
  misc_feature (4)..(9): the `n' at positions 4-9 may be any nucleic acid
cgcnnnnnngga

SEQ ID NO: 547 - DNA, 13 bp, Artificial Sequence
  Dyad patterns over-represented in STAR elements
  misc_feature (4)..(10): the `n' at positions 4-10 may be any nucleic acid
cgcnnnnnnnagc

SEQ ID NO: 548 - DNA, 19 bp, Artificial Sequence
  Dyad patterns over-represented in STAR elements
  misc_feature (4)..(16): the `n' at positions 4-16 may be any nucleic acid
ccannnnnnnnnnnnncgg

SEQ ID NO: 549 - DNA, 12 bp, Artificial Sequence
  Dyad patterns over-represented in STAR elements
  misc_feature (4)..(9): the `n' at positions 4-9 may be any nucleic acid
cggnnnnnngga

SEQ ID NO: 550 - DNA, 25 bp, Artificial Sequence
  Dyad patterns over-represented in STAR elements
  misc_feature (4)..(22): the `n' at positions 4-22 may be any nucleic acid
cgcnnnnnnnnnnnnnnnnnnngcc

SEQ ID NO: 551 - DNA, 18 bp, Artificial Sequence
  Dyad patterns over-represented in STAR elements
  misc_feature (4)..(15): the `n' at positions 4-15 may be any nucleic acid
ccannnnnnnnnnnncgc

SEQ ID NO: 552 - DNA, 7 bp, Artificial Sequence
  Dyad patterns over-represented in STAR elements
  misc_feature (4)..(4): the `n' at position 4 may be any nucleic acid
cggnggc

SEQ ID NO: 553 - DNA, 9 bp, Artificial Sequence
  Dyad patterns over-represented in STAR elements
  misc_feature (4)..(6): the `n' at positions 4-6 may be any nucleic acid
gcgnnncca

SEQ ID NO: 554 - DNA, 7 bp, Artificial Sequence
  Dyad patterns over-represented in STAR elements
  misc_feature (4)..(4): the `n' at position 4 may be any nucleic acid
aggncgc

SEQ ID NO: 555 - DNA, 11 bp, Artificial Sequence
  Dyad patterns over-represented in STAR elements
  misc_feature (4)..(8): the `n' at positions 4-8 may be any nucleic acid
ctcnnnnncgc

SEQ ID NO: 556 - DNA, 6 bp, Artificial Sequence
  Dyad patterns over-represented in STAR elements
cccacg

SEQ ID NO: 557 - DNA, 23 bp, Artificial Sequence
  Dyad patterns over-represented in STAR elements
  misc_feature (4)..(20): the `n' at positions 4-20 may be any nucleic acid
cagnnnnnnnnnnnnnnnnnccg

SEQ ID NO: 558 - DNA, 10 bp, Artificial Sequence
  Dyad patterns over-represented in STAR elements
  misc_feature (4)..(7): the `n' at positions 4-7 may be any nucleic acid
ggcnnnnccc

SEQ ID NO: 559 - DNA, 14 bp, Artificial Sequence
  Dyad patterns over-represented in STAR elements
  misc_feature (4)..(11): the `n' at positions 4-11 may be any nucleic acid acid
aggnnnnnnnngcg

SEQ ID NO: 560 - DNA, 7 bp, Artificial Sequence
  Dyad patterns over-represented in STAR elements
  misc_feature (4)..(4): the `n' at position 4 may be any nucleic acid
ctgnccc

SEQ ID NO: 561 - DNA, 22 bp, Artificial Sequence
  Dyad patterns over-represented in STAR elements
  misc_feature (4)..(19): the `n' at positions 4-19 may be any nucleic acid
cccnnnnnnnnnnnnnnnncag

SEQ ID NO: 562 - DNA, 15 bp, Artificial Sequence
  Dyad patterns over-represented in STAR elements
  misc_feature (4)..(12): the `n' at positions 4-12 may be any nucleic acid
cgcnnnnnnnnngac

SEQ ID NO: 563 - DNA, 12 bp, Artificial Sequence
  Dyad patterns over-represented in STAR elements
  misc_feature (4)..(9): the `n' at positions 4-9 may be any nucleic acid
cagnnnnnnccg

SEQ ID NO: 564 - DNA, 18 bp, Artificial Sequence
  Dyad patterns over-represented in STAR elements
  misc_feature (4)..(15): the `n' at positions 4-15 may be any nucleic acid
cgtnnnnnnnnnnnncgc

SEQ ID NO: 565 - DNA, 13 bp, Artificial Sequence
  Dyad patterns over-represented in STAR elements
  misc_feature (4)..(10): the `n' at positions 4-10 may be any nucleic acid
ctcnnnnnnngcc

SEQ ID NO: 566 - DNA, 25 bp, Artificial Sequence
  Dyad patterns over-represented in STAR elements
  misc_feature (4)..(22): the `n' at positions 4-22 may be any nucleic acid
cgcnnnnnnnnnnnnnnnnnnntcc

SEQ ID NO: 567 - DNA, 13 bp, Artificial Sequence
  Dyad patterns over-represented in STAR elements
  misc_feature (4)..(10): the `n' at positions 4-10 may be any nucleic acid
cccnnnnnnngcc

SEQ ID NO: 568 - DNA, 19 bp, Artificial Sequence
  Dyad patterns over-represented in STAR elements
  misc_feature (4)..(16): the `n' at positions 4-16 may be any nucleic acid
cagnnnnnnnnnnnnncgg

SEQ ID NO: 569 - DNA, 7 bp, Artificial Sequence
  Dyad patterns over-represented in STAR elements
  misc_feature (4)..(4): the `n' at position 4 may be any nucleic acid
cgcngcc

SEQ ID NO: 570 - DNA, 23 bp, Artificial Sequence
  Dyad patterns over-represented in STAR elements
  misc_feature (4)..(20): the `n' at positions 4-20 may be any nucleic acid
cgcnnnnnnnnnnnnnnnnnccg

SEQ ID NO: 571 - DNA, 10 bp, Artificial Sequence
  Dyad patterns over-represented in STAR elements
  misc_feature (4)..(7): the `n' at positions 4-7 may be any nucleic acid
aggnnnnccc

SEQ ID NO: 572 - DNA, 16 bp, Artificial Sequence
  Dyad patterns over-represented in STAR elements
  misc_feature (4)..(13): the `n' at positions 4-13 may be any nucleic acid
agcnnnnnnnnnncgc

SEQ ID NO: 573 - DNA, 17 bp, Artificial Sequence
  Dyad patterns over-represented in STAR elements
  misc_feature (4)..(14): the `n' at positions 4-14 may be any nucleic acid
cccnnnnnnnnnnncgg

SEQ ID NO: 574 - DNA, 14 bp, Artificial Sequence
  Dyad patterns over-represented in STAR elements
  misc_feature (4)..(11): the `n' at positions 4-11 may be any nucleic acid
cccnnnnnnnngcc

SEQ ID NO: 575 - DNA, 7 bp, Artificial Sequence
  Dyad patterns over-represented in STAR elements
  misc_feature (4)..(4): the `n' at position 4 may be any nucleic acid
ccgncgg

SEQ ID NO: 576 - DNA, 7 bp, Artificial Sequence
  Dyad patterns over-represented in STAR elements
  misc_feature (4)..(4): the `n' at position 4 may be any nucleic acid
cccnacc

SEQ ID NO: 577 - DNA, 6 bp, Artificial Sequence
  Dyad patterns over-represented in STAR elements
cgccag

SEQ ID NO: 578 - DNA, 25 bp, Artificial Sequence
  Dyad patterns over-represented in STAR elements
  misc_feature (4)..(22): the `n' at positions 4-22 may be any nucleic acid
ccgnnnnnnnnnnnnnnnnnnntgc

SEQ ID NO: 579 - DNA, 10 bp, Artificial Sequence
  Dyad patterns over-represented in STAR elements
  misc_feature (4)..(7): the `n' at positions 4-7 may be any nucleic acid
gcgnnnncga

SEQ ID NO: 580 - DNA, 25 bp, Artificial Sequence
  Dyad patterns over-represented in STAR elements
  misc_feature (4)..(22): the `n' at positions 4-22 may be any nucleic acid
ccgnnnnnnnnnnnnnnnnnnngcc

SEQ ID NO: 581 - DNA, 16 bp, Artificial Sequence
  Dyad patterns over-represented in STAR elements
  misc_feature (4)..(13): the `n' at positions 4-13 may be any nucleic acid
ccannnnnnnnnnccc

SEQ ID NO: 582 - DNA, 19 bp, Artificial Sequence
  Dyad patterns over-represented in STAR elements
  misc_feature (4)..(16): the `n' at positions 4-16 may be any nucleic acid
cagnnnnnnnnnnnnnggg

SEQ ID NO: 583 - DNA, 24 bp, Artificial Sequence
  Dyad patterns over-represented in STAR elements
  misc_feature (4)..(21): the `n' at positions 4-21 may be any nucleic acid
agcnnnnnnnnnnnnnnnnnncgg

SEQ ID NO: 584 - DNA, 14 bp, Artificial Sequence
  Dyad patterns over-represented in STAR elements
  misc_feature (4)..(11): the `n' at positions 4-11 may be any nucleic acid
cgannnnnnnncgc

SEQ ID NO: 585 - DNA, 10 bp, Artificial Sequence
  Dyad patterns over-represented in STAR elements
  misc_feature (4)..(7): the `n' at positions 4-7 may be any nucleic acid
agcnnnnccc

SEQ ID NO: 586 - DNA, 12 bp, Artificial Sequence
  Dyad patterns over-represented in STAR elements
  misc_feature (4)..(9): the `n' at positions 4-9 may be any nucleic acid
ggannnnnnccc

SEQ ID NO: 587 - DNA, 19 bp, Artificial Sequence
  Dyad patterns over-represented in STAR elements
  misc_feature (4)..(16): the `n' at positions 4-16 may be any nucleic acid
cggnnnnnnnnnnnnnaag

SEQ ID NO: 588 - DNA, 17 bp, Artificial Sequence
  Dyad patterns over-represented in STAR elements
  misc_feature (4)..(14): the `n' at positions 4-14 may be any nucleic acid
accnnnnnnnnnnncgc

SEQ ID NO: 589 - DNA, 18 bp, Artificial Sequence
  Dyad patterns over-represented in STAR elements
  misc_feature (4)..(15): the `n' at positions 4-15 may be any nucleic acid
ccgnnnnnnnnnnnncag

SEQ ID NO: 590 - DNA, 18 bp, Artificial Sequence
  Dyad patterns over-represented in STAR elements
  misc_feature (4)..(15): the `n' at positions 4-15 may be any nucleic acid
cccnnnnnnnnnnnnggg

SEQ ID NO: 591 - DNA, 23 bp, Artificial Sequence
  Dyad patterns over-represented in STAR elements
  misc_feature (4)..(20): the `n' at positions 4-20 may be any nucleic acid
cacnnnnnnnnnnnnnnnnnacg

SEQ ID NO: 592 - DNA, 24 bp, Artificial Sequence
  Dyad patterns over-represented in STAR elements
  misc_feature (4)..(21): the `n' at positions 4-21 may be any nucleic acid
cagnnnnnnnnnnnnnnnnnnccc

SEQ ID NO: 593 - DNA, 16 bp, Artificial Sequence
  Dyad patterns over-represented in STAR elements
  misc_feature (4)..(13): the `n' at positions 4-13 may be any nucleic acid
cgtnnnnnnnnnngtc

SEQ ID NO: 594 - DNA, 19 bp, Artificial Sequence
  Dyad patterns over-represented in STAR elements
  misc_feature (4)..(16): the `n' at positions 4-16 may be any nucleic acid
cccnnnnnnnnnnnnngcg

SEQ ID NO: 595 - DNA, 7 bp, Artificial Sequence
  Dyad patterns over-represented in STAR elements
  misc_feature (4)..(4): the `n' at position 4 may be any nucleic acid
gcancgc

SEQ ID NO: 596 - DNA, 10 bp, Artificial Sequence
  Dyad patterns over-represented in STAR elements
  misc_feature (4)..(7): the `n' at positions 4-7 may be any nucleic acid
agannnnccg

SEQ ID NO: 597 - DNA, 16 bp, Artificial Sequence
  Dyad patterns over-represented in STAR elements
  misc_feature (4)..(13): the `n' at positions 4-13 may be any nucleic acid
gcgnnnnnnnnnnagc

SEQ ID NO: 598 - DNA, 6 bp, Artificial Sequence
  Dyad patterns over-represented in STAR elements
cgcgga

SEQ ID NO: 599 - DNA, 10 bp, Artificial Sequence
  Dyad patterns over-represented in STAR elements
  misc_feature (4)..(7): the `n' at positions 4-7 may be any nucleic acid
cggnnnngac

SEQ ID NO: 600 - DNA, 18 bp, Artificial Sequence
  Dyad patterns over-represented in STAR elements
  misc_feature (4)..(15): the `n' at positions 4-15 may be any nucleic acid
cccnnnnnnnnnnnncgc

SEQ ID NO: 601 - DNA, 21 bp, Artificial Sequence
  Dyad patterns over-represented in STAR elements
  misc_feature (4)..(18): the `n' at positions 4-18 may be any nucleic acid
gccnnnnnnnnnnnnnnnccc

SEQ ID NO: 602 - DNA, 12 bp, Artificial Sequence
  Dyad patterns over-represented in STAR elements
  misc_feature (4)..(9): the `n' at positions 4-9 may be any nucleic acid
gcgnnnnnntcc

SEQ ID NO: 603 - DNA, 9 bp, Artificial Sequence
  Dyad patterns over-represented in STAR elements
  misc_feature (4)..(6): the `n' at positions 4-6 may be any nucleic acid
cggnnncag

SEQ ID NO: 604 - DNA, 9 bp, Artificial Sequence
  Dyad patterns over-represented in STAR elements
  misc_feature (4)..(6): the `n' at positions 4-6 may be any nucleic acid
cccnnncca

SEQ ID NO: 605 - DNA, 9 bp, Artificial Sequence
  Dyad patterns over-represented in STAR elements
  misc_feature (4)..(6): the `n' at positions 4-6 may be any nucleic acid
agcnnnccc

SEQ ID NO: 606 - DNA, 22 bp, Artificial Sequence
  Dyad patterns over-represented in STAR elements
  misc_feature (4)..(19): the `n' at positions 4-19 may be any nucleic acid
gggnnnnnnnnnnnnnnnngca

SEQ ID NO: 607 - DNA, 14 bp, Artificial Sequence
  Dyad patterns over-represented in STAR elements
  misc_feature (4)..(11): the `n' at positions 4-11 may be any nucleic acid
aggnnnnnnnnccg

SEQ ID NO: 608 - DNA, 6 bp, Artificial Sequence
  Dyad patterns over-represented in STAR elements
cccccg

SEQ ID NO: 609 - DNA, 11 bp, Artificial Sequence
  Dyad patterns over-represented in STAR elements
  misc_feature (4)..(8): the `n' at positions 4-8 may be any nucleic acid
gcgnnnnngac

SEQ ID NO: 610 - DNA, 15 bp, Artificial Sequence
  Dyad patterns over-represented in STAR elements
  misc_feature (4)..(12): the `n' at positions 4-12 may be any nucleic acid
cccnnnnnnnnnacc

SEQ ID NO: 611 - DNA, 11 bp, Artificial Sequence
  Dyad patterns over-represented in STAR elements
  misc_feature (4)..(8): the `n' at positions 4-8 may be any nucleic acid
ctgnnnnncgc

SEQ ID NO: 612 - DNA, 20 bp, Artificial Sequence
  Dyad patterns over-represented in STAR elements
  misc_feature (4)..(17): the `n' at positions 4-17 may be any nucleic acid
cgcnnnnnnnnnnnnnnctc

SEQ ID NO: 613 - DNA, 20 bp, Artificial Sequence
  Dyad patterns over-represented in STAR elements
  misc_feature (4)..(17): the `n' at positions 4-17 may be any nucleic acid
cggnnnnnnnnnnnnnngca

SEQ ID NO: 614 - DNA, 14 bp, Artificial Sequence
  Dyad patterns over-represented in STAR elements
  misc_feature (4)..(11): the `n' at positions 4-11 may be any nucleic acid
ccgnnnnnnnngcc

SEQ ID NO: 615 - DNA, 13 bp, Artificial Sequence
  Dyad patterns over-represented in STAR elements
  misc_feature (4)..(10): the `n' at positions 4-10 may be any nucleic acid
ccgnnnnnnncac

SEQ ID NO: 616 - DNA, 14 bp, Artificial Sequence
  Dyad patterns over-represented in STAR elements
  misc_feature (4)..(11): the `n' at positions 4-11 may be any nucleic acid
agcnnnnnnnngcg

SEQ ID NO: 617 - DNA, 22 bp, Artificial Sequence
  Dyad patterns over-represented in STAR elements
  misc_feature (4)..(19): the `n' at positions 4-19 may be any nucleic acid
cggnnnnnnnnnnnnnnnngga

SEQ ID NO: 618 - DNA, 18 bp, Artificial Sequence
  Dyad patterns over-represented in STAR elements
  misc_feature (4)..(15): the `n' at positions 4-15 may be any nucleic acid
ccannnnnnnnnnnnccg

SEQ ID NO: 619 - DNA, 8 bp, Artificial Sequence
  Dyad patterns over-represented in STAR elements
  misc_feature (4)..(5): the `n' at positions 4-5 may be any nucleic acid
cggnnccc

SEQ ID NO: 620 - DNA, 19 bp, Artificial Sequence
  Dyad patterns over-represented in STAR elements
  misc_feature (4)..(16): the `n' at positions 4-16 may be any nucleic acid
ccannnnnnnnnnnnnggg

SEQ ID NO: 621 - DNA, 21 bp, Artificial Sequence
  Dyad patterns over-represented in STAR elements
  misc_feature (4)..(18): the `n' at positions 4-18 may be any nucleic acid
cggnnnnnnnnnnnnnnngca

SEQ ID NO: 622 - DNA, 15 bp, Artificial Sequence
  Dyad patterns over-represented in STAR elements
  misc_feature (4)..(12): the `n' at positions 4-12 may be any nucleic acid
cgcnnnnnnnnngca

SEQ ID NO: 623 - DNA, 25 bp, Artificial Sequence
  Dyad patterns over-represented in STAR elements
  misc_feature (4)..(22): the `n' at positions 4-22 may be any nucleic acid
cggnnnnnnnnnnnnnnnnnnncca

SEQ ID NO: 624 - DNA, 21 bp, Artificial Sequence
  Dyad patterns over-represented in STAR elements
  misc_feature (4)..(18): the `n' at positions 4-18 may be any nucleic acid
gggnnnnnnnnnnnnnnncga

SEQ ID NO: 625 - DNA, 16 bp, Artificial Sequence
  Dyad patterns over-represented in STAR elements
  misc_feature (4)..(13): the `n' at positions 4-13 may be any nucleic acid
cccnnnnnnnnnncgc

SEQ ID NO: 626 - DNA, 20 bp, Artificial Sequence
  Dyad patterns over-represented in STAR elements
  misc_feature (4)..(17): the `n' at positions 4-17 may be any nucleic acid
ctcnnnnnnnnnnnnnncgc

SEQ ID NO: 627 - DNA, 17 bp, Artificial Sequence
  Dyad patterns over-represented in STAR elements
  misc_feature (4)..(14): the `n' at positions 4-14 may be any nucleic acid
cacnnnnnnnnnnngcg

SEQ ID NO: 628 - DNA, 8 bp, Artificial Sequence
  Dyad patterns over-represented in STAR elements
  misc_feature (4)..(5): the `n' at positions 4-5 may be any nucleic acid
ccgnnggc

SEQ ID NO: 629 - DNA, 24 bp, Artificial Sequence
  Dyad patterns over-represented in STAR elements
  misc_feature (4)..(21): the `n' at positions 4-21 may be any nucleic acid
ctgnnnnnnnnnnnnnnnnnnccc

SEQ ID NO: 630 - DNA, 19 bp, Artificial Sequence
  Dyad patterns over-represented in STAR elements
  misc_feature (4)..(16): the `n' at positions 4-16 may be any nucleic acid
gggnnnnnnnnnnnnncac

SEQ ID NO: 631 - DNA, 21 bp, Artificial Sequence
  Dyad patterns over-represented in STAR elements
  misc_feature (4)..(18): the `n' at positions 4-18 may be any nucleic acid
cctnnnnnnnnnnnnnnnggc

SEQ ID NO: 632 - DNA, 26 bp, Artificial Sequence
  Dyad patterns over-represented in STAR elements
  misc_feature (4)..(23): the `n' at positions 4-23 may be any nucleic acid
cccnnnnnnnnnnnnnnnnnnnncga

SEQ ID NO: 633 - DNA, 14 bp, Artificial Sequence
  Dyad patterns over-represented in STAR elements
  misc_feature (4)..(11): the `n' at positions 4-11 may be any nucleic acid
cccnnnnnnnncga

SEQ ID NO: 634 - DNA, 13 bp, Artificial Sequence
  Dyad patterns over-represented in STAR elements
  misc_feature (4)..(10): the `n' at positions 4-10 may be any nucleic acid
gagnnnnnnnccc

SEQ ID NO: 635 - DNA, 8 bp, Artificial Sequence
  Dyad patterns over-represented in STAR elements
  misc_feature (4)..(5): the `n' at positions 4-5 may be any nucleic acid
cgcnnccg

SEQ ID NO: 636 - DNA, 6 bp, Artificial Sequence
  Dyad patterns over-represented in STAR elements
ccctcc

SEQ ID NO: 637 - DNA, 6 bp, Artificial Sequence
  Dyad patterns over-represented in STAR elements
agcgcc

SEQ ID NO: 638 - DNA, 8 bp, Artificial Sequence
  Dyad patterns over-represented in STAR elements
  misc_feature (4)..(5): the `n' at positions 4-5 may be any nucleic acid
cccnntcc

SEQ ID NO: 639 - DNA, 11 bp, Artificial Sequence
  Dyad patterns over-represented in STAR elements
  misc_feature (4)..(8): the `n' at positions 4-8 may be any nucleic acid
ccgnnnnnccc

SEQ ID NO: 640 - DNA, 19 bp, Artificial Sequence
  Dyad patterns over-represented in STAR elements
  misc_feature (4)..(16): the `n' at positions 4-16 may be any nucleic acid
cgcnnnnnnnnnnnnncgc

SEQ ID NO: 641 - DNA, 7 bp, Artificial Sequence
  Dyad patterns over-represented in STAR elements
  misc_feature (4)..(4): the `n' at position 4 may be any nucleic acid
cccncgc

SEQ ID NO: 642 - DNA, 22 bp, Artificial Sequence
  Dyad patterns over-represented in STAR elements
  misc_feature (4)..(19): the `n' at positions 4-19 may be any nucleic acid
gccnnnnnnnnnnnnnnnngca

SEQ ID NO: 643 - DNA, 22 bp, Artificial Sequence
  Dyad patterns over-represented in STAR elements
  misc_feature (4)..(19): the `n' at positions 4-19 may be any nucleic acid
cccnnnnnnnnnnnnnnnncca

SEQ ID NO: 644 - DNA, 19 bp, Artificial Sequence
  Dyad patterns over-represented in STAR elements
  misc_feature (4)..(16): the `n' at positions 4-16 may be any nucleic acid
ccgnnnnnnnnnnnnncgc

SEQ ID NO: 645 - DNA, 23 bp, Artificial Sequence
  Dyad patterns over-represented in STAR elements
  misc_feature (4)..(20): the `n' at positions 4-20 may be any nucleic acid
ccgnnnnnnnnnnnnnnnnncag

SEQ ID NO: 646 - DNA, 24 bp, Artificial Sequence
  Dyad patterns over-represented in STAR elements
  misc_feature (4)..(21): the `n' at positions 4-21 may be any nucleic acid
cggnnnnnnnnnnnnnnnnnnggc

SEQ ID NO: 647 - DNA, 20 bp, Artificial Sequence
  Dyad patterns over-represented in STAR elements
  misc_feature (4)..(17): the `n' at positions 4-17 may be any nucleic acid
ccgnnnnnnnnnnnnnnagg

SEQ ID NO: 648 - DNA, 11 bp, Artificial Sequence
  Dyad patterns over-represented in STAR elements
  misc_feature (4)..(8): the `n' at positions 4-8 may be any nucleic acid
cccnnnnncgg

SEQ ID NO: 649 - DNA, 12 bp, Artificial Sequence
  Dyad patterns over-represented in STAR elements
  misc_feature (4)..(9): the `n' at positions 4-9 may be any nucleic acid
cccnnnnnngga

SEQ ID NO: 650 - DNA, 8 bp, Artificial Sequence
  Dyad patterns over-represented in STAR elements
  misc_feature (4)..(5): the `n' at positions 4-5 may be any nucleic acid
acgnnccc

SEQ ID NO: 651 - DNA, 15 bp, Artificial Sequence
  Dyad patterns over-represented in STAR elements
  misc_feature (4)..(12): the `n' at positions 4-12 may be any nucleic acid
ccannnnnnnnnccg

SEQ ID NO: 652 - DNA, 25 bp, Artificial Sequence
  Dyad patterns over-represented in STAR elements
  misc_feature (4)..(22): the `n' at positions 4-22 may be any nucleic acid
cccnnnnnnnnnnnnnnnnnnncca

SEQ ID NO: 653 - DNA, 6 bp, Artificial Sequence
  Dyad patterns over-represented in STAR elements
cagggg

SEQ ID NO: 654 - DNA, 7 bp, Artificial Sequence
  Dyad patterns over-represented in STAR elements
  misc_feature (4)..(4): the `n' at position 4 may be any nucleic acid
agcnccc

SEQ ID NO: 655 - DNA, 13 bp, Artificial Sequence
  Dyad patterns over-represented in STAR elements
  misc_feature (4)..(10): the `n' at positions 4-10 may be any nucleic acid
gcgnnnnnnntcc

SEQ ID NO: 656 - DNA, 24 bp, Artificial Sequence
  Dyad patterns over-represented in STAR elements
  misc_feature (4)..(21): the `n' at positions 4-21 may be any nucleic acid
acgnnnnnnnnnnnnnnnnnncca

SEQ ID NO: 657 - DNA, 20 bp, Artificial Sequence
  Dyad patterns over-represented in STAR elements
  misc_feature (4)..(17): the `n' at positions 4-17 may be any nucleic acid
gctnnnnnnnnnnnnnnccc

SEQ ID NO: 658 - DNA, 20 bp, Artificial Sequence
  Dyad patterns over-represented in STAR elements
  misc_feature (4)..(17): the `n' at positions 4-17 may be any nucleic acid
gcgnnnnnnnnnnnnnnccc

SEQ ID NO: 659 - DNA, 25 bp, Artificial Sequence
  Dyad patterns over-represented in STAR elements
  misc_feature (4)..(22): the `n' at positions 4-22 may be any nucleic acid
gcgnnnnnnnnnnnnnnnnnnnagc

SEQ ID NO: 660 - DNA, 14 bp, Artificial Sequence
  Dyad patterns over-represented in STAR elements
  misc_feature (4)..(11): the `n' at positions 4-11 may be any nucleic acid
ccgnnnnnnnncag

SEQ ID NO: 661 - DNA, 12 bp, Artificial Sequence
  Dyad patterns over-represented in STAR elements
  misc_feature (4)..(9): the `n' at positions 4-9 may be any nucleic acid
gcgnnnnnngcc

SEQ ID NO: 662 - DNA, 16 bp, Artificial Sequence
  Dyad patterns over-represented in STAR elements
  misc_feature (4)..(13): the `n' at positions 4-13 may be any nucleic acid
gcgnnnnnnnnnngca

SEQ ID NO: 663 - DNA, 13 bp, Artificial Sequence
  Dyad patterns over-represented in STAR elements
  misc_feature (4)..(10): the `n' at positions 4-10 may be any nucleic acid
cctnnnnnnngcc

SEQ ID NO: 664 - DNA, 19 bp, Artificial Sequence
  Dyad patterns over-represented in STAR elements
  misc_feature (4)..(16): the `n' at positions 4-16 may be any nucleic acid
gccnnnnnnnnnnnnngcc

SEQ ID NO: 665 - DNA, 20 bp, Artificial Sequence
  Dyad patterns over-represented in STAR elements
  misc_feature (4)..(17): the `n' at positions 4-17 may be any nucleic acid
cccnnnnnnnnnnnnnngcc

SEQ ID NO: 666 - DNA, 21 bp, Artificial Sequence
  Dyad patterns over-represented in STAR elements
  misc_feature (4)..(18): the `n' at positions 4-18 may be any nucleic acid
cccnnnnnnnnnnnnnnncgg

SEQ ID NO: 667 - DNA, 19 bp, Artificial Sequence
  Dyad patterns over-represented in STAR elements
  misc_feature (4)..(16): the `n' at positions 4-16 may be any nucleic acid
ccannnnnnnnnnnnncgc

SEQ ID NO: 668 - DNA, 17 bp, Artificial Sequence
  Dyad patterns over-represented in STAR elements
  misc_feature (4)..(14): the `n' at positions 4-14 may be any nucleic acid
agcnnnnnnnnnnnggg

SEQ ID NO: 669 - DNA, 6 bp, Artificial Sequence
  Dyad patterns over-represented in STAR elements
ggagcc

SEQ ID NO: 670 - DNA, 9 bp, Artificial Sequence
  Dyad patterns over-represented in STAR elements
  misc_feature (4)..(6): the `n' at positions 4-6 may be any nucleic acid
gccnnntcc

SEQ ID NO: 671 - DNA, 11 bp, Artificial Sequence
  Dyad patterns over-represented in STAR elements
  misc_feature (4)..(8): the `n' at positions 4-8 may be any nucleic acid
cctnnnnngcc

SEQ ID NO: 672 - DNA, 24 bp, Artificial Sequence
  Dyad patterns over-represented in STAR elements
  misc_feature (4)..(21): the `n' at positions 4-21 may be any nucleic acid
cggnnnnnnnnnnnnnnnnnnccc

SEQ ID NO: 673 - DNA, 9 bp, Artificial Sequence
  Dyad patterns over-represented in STAR elements
  misc_feature (4)..(6): the `n' at positions 4-6 may be any nucleic acid
cctnnnggc

SEQ ID NO: 674 - DNA, 6 bp, Artificial Sequence
  Dyad patterns over-represented in STAR elements
ccgctc

SEQ ID NO: 675 - DNA, 23 bp, Artificial Sequence
  Dyad patterns over-represented in STAR elements
  misc_feature (1)..(20): the `n' at positions 4-20 may be any nucleic acid
agcnnnnnnnnnnnnnnnnngcg

SEQ ID NO: 676 - DNA, 20 bp, Artificial Sequence
  Dyad patterns over-represented in STAR elements
  misc_feature (4)..(17): the `n' at positions 4-17 may be any nucleic acid
acgnnnnnnnnnnnnnnggg

SEQ ID NO: 677 - DNA, 18 bp, Artificial Sequence
  Dyad patterns over-represented in STAR elements
  misc_feature (4)..(15): the `n' at positions 4-15 may be any nucleic acid
cgannnnnnnnnnnnggc

SEQ ID NO: 678 - DNA, 26 bp, Artificial Sequence
  Dyad patterns over-represented in STAR elements
  misc_feature (4)..(23): the `n' at positions 4-23 may be any nucleic acid
cccnnnnnnnnnnnnnnnnnnnncgc

SEQ ID NO: 679 - DNA, 18 bp, Artificial Sequence
  Dyad patterns over-represented in STAR elements
  misc_feature (4)..(15): the `n' at positions 4-15 may be any nucleic acid
acgnnnnnnnnnnnnctg

SEQ ID NO: 680 - DNA, 6 bp, Artificial Sequence
  Dyad patterns over-represented in STAR elements
ccgccc

SEQ ID NO: 681 - DNA, 16 bp, Artificial Sequence
  Dyad patterns over-represented in STAR elements
  misc_feature (4)..(13): the `n' at positions 4-13 may be any nucleic acid
ccgnnnnnnnnnngga

SEQ ID NO: 682 - DNA, 9 bp, Artificial Sequence
  Dyad patterns over-represented in STAR elements
  misc_feature (4)..(6): the `n' at positions 4-6 may be any nucleic acid
cccnnngcg

SEQ ID NO: 683 - DNA, 20 bp, Artificial Sequence
  Dyad patterns over-represented in STAR elements
  misc_feature (4)..(17): the `n' at positions 4-17 may be any nucleic acid
gcgnnnnnnnnnnnnnncgc

SEQ ID NO: 684 - DNA, 14 bp, Artificial Sequence
  Dyad patterns over-represented in STAR elements
  misc_feature (4)..(11): the `n' at positions 4-11 may be any nucleic acid
ccgnnnnnnnncgc

SEQ ID NO: 685 - DNA, 16 bp, Artificial Sequence
  Dyad patterns over-represented in STAR elements
  misc_feature (4)..(13): the `n' at positions 4-13 may be any nucleic acid
cgcnnnnnnnnnnaca

SEQ ID NO: 686 - DNA, 25 bp, Artificial Sequence
  Dyad patterns over-represented in STAR elements
  misc_feature (4)..(22): the `n' at positions 4-22 may be any nucleic acid
cccnnnnnnnnnnnnnnnnnnnccg

SEQ ID NO: 687 - DNA, 20 bp, Artificial Sequence
  Dyad patterns over-represented in STAR elements
  misc_feature (4)..(17): the `n' at positions 4-17 may be any nucleic acid
cacnnnnnnnnnnnnnncgc

SEQ ID NO: 688 - DNA, 9 bp, Artificial Sequence
  Dyad patterns over-represented in STAR elements
  misc_feature (4)..(6): the `n' at positions 4-6 may be any nucleic acid
gacnnnggc

SEQ ID NO: 689 - DNA, 13 bp, Artificial Sequence
  Dyad patterns over-represented in STAR elements
  misc_feature (4)..(10): the `n' at positions 4-10 may be any nucleic acid
gaannnnnnncgc

SEQ ID NO: 690 - DNA, 22 bp, Artificial Sequence
  Dyad patterns over-represented in STAR elements
  misc_feature (4)..(19): the `n' at positions 4-19 may be any nucleic acid
cgcnnnnnnnnnnnnnnnnggc

SEQ ID NO: 691 - DNA, 15 bp, Artificial Sequence
  Dyad patterns over-represented in STAR elements
  misc_feature (4)..(12): the `n' at positions 4-12 may be any nucleic acid
ggcnnnnnnnnnccc

SEQ ID NO: 692 - DNA, 15 bp, Artificial Sequence
  Dyad patterns over-represented in STAR elements
  misc_feature (4)..(12): the `n' at positions 4-12 may be any nucleic acid
cccnnnnnnnnngcc

SEQ ID NO: 693 - DNA, 6 bp, Artificial Sequence
  Dyad patterns over-represented in STAR elements
cgctgc

SEQ ID NO: 694 - DNA, 14 bp, Artificial Sequence
  Dyad patterns over-represented in STAR elements
  misc_feature (4)..(11): the `n' at positions 4-11 may be any nucleic acid
cctnnnnnnnnggc

SEQ ID NO: 695 - DNA, 14 bp, Artificial Sequence
  Dyad patterns over-represented in STAR elements
  misc_feature (4)..(11): the `n' at positions 4-11 may be any nucleic acid
ccannnnnnnnccc

SEQ ID NO: 696 - DNA, 8 bp, Artificial Sequence
  Dyad patterns over-represented in STAR elements
  misc_feature (4)..(5): the `n' at positions 4-5 may be any nucleic acid
gacnnccc

SEQ ID NO: 697 - DNA, 7 bp, Artificial Sequence
  Dyad patterns over-represented in STAR elements
  misc_feature (4)..(4): the `n' at position 4 may be any nucleic acid
ggcnccc

SEQ ID NO: 698 - DNA, 6 bp, Artificial Sequence
  Dyad patterns over-represented in STAR elements
cgcagc

SEQ ID NO: 699 - DNA, 10 bp, Artificial Sequence
  Dyad patterns over-represented in STAR elements
  misc_feature (4)..(7): the `n' at positions 4-7 may be any nucleic acid
aggnnnngcg

SEQ ID NO: 700 - DNA, 12 bp, Artificial Sequence
  Dyad patterns over-represented in STAR elements
  misc_feature (4)..(9): the `n' at positions 4-9 may be any nucleic acid
cggnnnnnntcc

SEQ ID NO: 701 - DNA, 25 bp, Artificial Sequence
  Dyad patterns over-represented in STAR elements
  misc_feature (4)..(22): the `n' at positions 4-22 may be any nucleic acid
acgnnnnnnnnnnnnnnnnnnnggc

SEQ ID NO: 702 - DNA, 14 bp, Artificial Sequence
  Dyad patterns over-represented in STAR elements
  misc_feature (4)..(11): the `n' at positions 4-11 may be any nucleic acid
cccnnnnnnnnacg

SEQ ID NO: 703 - DNA, 24 bp, Artificial Sequence
  Dyad patterns over-represented in STAR elements
  misc_feature (4)..(21): the `n' at positions 4-21 may be any nucleic acid
cccnnnnnnnnnnnnnnnnnngcc

SEQ ID NO: 704 - DNA, 8 bp, Artificial Sequence
  Dyad patterns over-represented in STAR elements
  misc_feature (4)..(5): the `n' at positions 4-5 may be any nucleic acid
gccnncga

SEQ ID NO: 705 - DNA, 14 bp, Artificial Sequence
  Dyad patterns over-represented in STAR elements
  misc_feature (4)..(11): the `n' at positions 4-11 may be any nucleic acid
cccnnnnnnnngcg

SEQ ID NO: 706 - DNA, 6 bp, Artificial Sequence
  Dyad patterns over-represented in STAR elements
cccctc

SEQ ID NO: 707 - DNA, 17 bp, Artificial Sequence
  Dyad patterns over-represented in STAR elements
  misc_feature (4)..(14): the `n' at positions 4-14 may be any nucleic acid
gccnnnnnnnnnnncgc

SEQ ID NO: 708 - DNA, 15 bp, Artificial Sequence
  Dyad patterns over-represented in STAR elements
  misc_feature (4)..(12): the `n' at positions 4-12 may be any nucleic acid
agcnnnnnnnnnccc

SEQ ID NO: 709 - DNA, 6 bp, Artificial Sequence
  Dyad patterns over-represented in STAR elements
gctgcc

SEQ ID NO: 710 - DNA, 9 bp, Artificial Sequence
  Dyad patterns over-represented in STAR elements
  misc_feature (4)..(6): the `n' at positions 4-6 may be any nucleic acid
cgcnnnccc

SEQ ID NO: 711 - DNA, 8 bp, Artificial Sequence
  Dyad patterns over-represented in STAR elements
  misc_feature (4)..(5): the `n' at positions 4-5 may be any nucleic acid
cccnnccc

SEQ ID NO: 712 - DNA, 15 bp, Artificial Sequence
  Dyad patterns over-represented in STAR elements
  misc_feature (4)..(12): the `n' at positions 4-12 may be any nucleic acid
gccnnnnnnnnncgc

SEQ ID NO: 713 - DNA, 25 bp, Artificial Sequence
  Dyad patterns over-represented in STAR elements
  misc_feature (4)..(22): the `n' at positions 4-22 may be any nucleic acid
gcannnnnnnnnnnnnnnnnnncgc

SEQ ID NO: 714 - DNA, 10 bp, Artificial Sequence
  Dyad patterns over-represented in STAR elements
  misc_feature (4)..(7): the `n' at positions 4-7 may be any nucleic acid
cagnnnncgg

SEQ ID NO: 715 - DNA, 8 bp, Artificial Sequence
  Dyad patterns over-represented in STAR elements
  misc_feature (4)..(5): the `n' at positions 4-5 may be any nucleic acid
cagnnggg

SEQ ID NO: 716 - DNA, 22 bp, Artificial Sequence
  Dyad patterns over-represented in STAR elements
  misc_feature (4)..(19): the `n' at positions 4-19 may be any nucleic acid
gccnnnnnnnnnnnnnnnnccc

SEQ ID NO: 717 - DNA, 11 bp, Artificial Sequence
  Dyad patterns over-represented in STAR elements
  misc_feature (4)..(8): the `n' at positions 4-8 may be any nucleic acid
gagnnnnnccc

SEQ ID NO: 718 - DNA, 22 bp, Artificial Sequence
  Dyad patterns over-represented in STAR elements
  misc_feature (4)..(19): the `n' at positions 4-19 may be any nucleic acid
cctnnnnnnnnnnnnnnnntcg

SEQ ID NO: 719 - DNA, 9 bp, Artificial Sequence
  Dyad patterns over-represented in STAR elements
  misc_feature (4)..(6): the `n' at positions 4-6 may be any nucleic acid
cccnnnggc

SEQ ID NO: 720 - DNA, 19 bp, Artificial Sequence
  Dyad patterns over-represented in STAR elements
  misc_feature (4)..(16): the `n' at positions 4-16 may be any nucleic acid
gcgnnnnnnnnnnnnngga

SEQ ID NO: 721 - DNA, 23 bp, Artificial Sequence
  Dyad patterns over-represented in STAR elements
  misc_feature (4)..(20): the `n' at positions 4-20 may be any nucleic acid
gccnnnnnnnnnnnnnnnnnggc

SEQ ID NO: 722 - DNA, 20 bp, Artificial Sequence
  Dyad patterns over-represented in STAR elements
  misc_feature (4)..(17): the `n' at positions 4-17 may be any nucleic acid
cccnnnnnnnnnnnnnnggc

SEQ ID NO: 723 - DNA, 9 bp, Artificial Sequence
  Dyad patterns over-represented in STAR elements
  misc_feature (4)..(6): the `n' at positions 4-6 may be any nucleic acid
aggnnnccg

SEQ ID NO: 724 - DNA, 6 bp, Artificial Sequence
  Dyad patterns over-represented in STAR elements
caccgc

SEQ ID NO: 725 - DNA, 24 bp, Artificial Sequence
  Dyad patterns over-represented in STAR elements
  misc_feature (4)..(21): the `n' at positions 4-21 may be any nucleic acid
cggnnnnnnnnnnnnnnnnnncag

SEQ ID NO: 726 - DNA, 7 bp, Artificial Sequence
  Dyad patterns over-represented in STAR elements
  misc_feature (4)..(4): the `n' at position 4 may be any nucleic acid
agcngcc

SEQ ID NO: 727 - DNA, 24 bp, Artificial Sequence
  Dyad patterns over-represented in STAR elements
  misc_feature (4)..(21): the `n' at positions 4-21 may be any nucleic acid
cgcnnnnnnnnnnnnnnnnnnggc

SEQ ID NO: 728 - DNA, 11 bp, Artificial Sequence
  Dyad patterns over-represented in STAR elements
  misc_feature (4)..(8): the `n' at positions 4-8 may be any nucleic acid
cccnnnnnagg

SEQ ID NO: 729 - DNA, 6 bp, Artificial Sequence
  Dyad patterns over-represented in STAR elements
aacgcg

SEQ ID NO: 730 - DNA, 16 bp, Artificial Sequence
  Dyad patterns over-represented in STAR elements
  misc_feature (4)..(13): the `n' at positions 4-13 may be any nucleic acid
cccnnnnnnnnnncca

SEQ ID NO: 731 - DNA, 19 bp, Artificial Sequence
  Dyad patterns over-represented in STAR elements
  misc_feature (4)..(16): the `n' at positions 4-16 may be any nucleic acid
cgcnnnnnnnnnnnnngag

SEQ ID NO: 732 - DNA, 13 bp, Artificial Sequence
  Dyad patterns over-represented in STAR elements
  misc_feature (4)..(10): the `n' at positions 4-10 may be any nucleic acid
cgcnnnnnnngcc

SEQ ID NO: 733 - DNA, 15 bp, Artificial Sequence
  Dyad patterns over-represented in STAR elements
  misc_feature (4)..(12): the `n' at positions 4-12 may be any nucleic acid
cccnnnnnnnnnccg

SEQ ID NO: 734 - DNA, 22 bp, Artificial Sequence
  Dyad patterns over-represented in STAR elements
  misc_feature (4)..(19): the `n' at positions 4-19 may be any nucleic acid
cgcnnnnnnnnnnnnnnnnccc

SEQ ID NO: 735 - DNA, 19 bp, Artificial Sequence
  Dyad patterns over-represented in STAR elements
  misc_feature (4)..(16): the `n' at positions 4-16 may be any nucleic acid
gaannnnnnnnnnnnncgc

SEQ ID NO: 736 - DNA, 9 bp, Artificial Sequence
  Dyad patterns over-represented in STAR elements
  misc_feature (4)..(6): the `n' at positions 4-6 may be any nucleic acid
ggcnnnccc

SEQ ID NO: 737 - DNA, 17 bp, Artificial Sequence
  Dyad patterns over-represented in STAR elements
  misc_feature (4)..(14): the `n' at positions 4-14 may be any nucleic acid
tccnnnnnnnnnnncca

SEQ ID NO: 738 - DNA, 6 bp, Artificial Sequence
  Dyad patterns over-represented in STAR elements
cacccc

SEQ ID NO: 739 - DNA, 22 bp, Artificial Sequence
  Dyad patterns over-represented in STAR elements
  misc_feature (4)..(19): the `n' at positions 4-19 may be any nucleic acid
cgcnnnnnnnnnnnnnnnnccg

SEQ ID NO: 740 - DNA, 21 bp, Artificial Sequence
  Dyad patterns over-represented in STAR elements
  misc_feature (4)..(18): the `n' at positions 4-18 may be any nucleic acid
cggnnnnnnnnnnnnnnnagc

SEQ ID NO: 741 - DNA, 18 bp, Artificial Sequence
  Dyad patterns over-represented in STAR elements
  misc_feature (4)..(15): the `n' at positions 4-15 may be any nucleic acid
cccnnnnnnnnnnnngcg

SEQ ID NO: 742 - DNA, 15 bp, Artificial Sequence
  Dyad patterns over-represented in STAR elements
  misc_feature (4)..(12): the `n' at positions 4-12 may be any nucleic acid
cccnnnnnnnnngag

SEQ ID NO: 743 - DNA, 26 bp, Artificial Sequence
  Dyad patterns over-represented in STAR elements
  misc_feature (4)..(23): the `n' at positions 4-23 may be any nucleic acid
ccgnnnnnnnnnnnnnnnnnnnntcc

SEQ ID NO: 744 - DNA, 6 bp, Artificial Sequence
  Dyad patterns over-represented in STAR elements
cgccgc

SEQ ID NO: 745 - DNA, 13 bp, Artificial Sequence
  Dyad patterns over-represented in STAR elements
  misc_feature (4)..(10): the `n' at positions 4-10 may be any nucleic acid
atgnnnnnnncgg

SEQ ID NO: 746 - DNA, 26 bp, Artificial Sequence
  Dyad patterns over-represented in STAR elements
  misc_feature (4)..(23): the `n' at positions 4-23 may be any nucleic acid
gggnnnnnnnnnnnnnnnnnnnngca

SEQ ID NO: 747 - DNA, 10 bp, Artificial Sequence
  Dyad patterns over-represented in STAR elements
  misc_feature (4)..(7): the `n' at positions 4-7 may be any nucleic acid
cggnnnnggc

SEQ ID NO: 748 - DNA, 22 bp, Artificial Sequence
  Dyad patterns over-represented in STAR elements
  misc_feature (4)..(19): the `n' at positions 4-19 may be any nucleic acid
cggnnnnnnnnnnnnnnnnagc

SEQ ID NO: 749 - DNA, 11 bp, Artificial Sequence
  Dyad patterns over-represented in STAR elements
  misc_feature (4)..(8): the `n' at positions 4-8 may be any nucleic acid
cggnnnnnggc

SEQ ID NO: 750 - DNA, 6 bp, Artificial Sequence
  Dyad patterns over-represented in STAR elements
gcggga

SEQ ID NO: 751 - DNA, 26 bp, Artificial Sequence
  Dyad patterns over-represented in STAR elements
  misc_feature (4)..(23): the `n' at positions 4-23 may be any nucleic acid
ggcnnnnnnnnnnnnnnnnnnnncac

SEQ ID NO: 752 - DNA, 15 bp, Artificial Sequence
  Dyad patterns over-represented in STAR elements
  misc_feature (4)..(12): the `n' at positions 4-12 may be any nucleic acid
cccnnnnnnnnnccc

SEQ ID NO: 753 - DNA, 23 bp, Artificial Sequence
  Dyad patterns over-represented in STAR elements
  misc_feature (4)..(20): the `n' at positions 4-20 may be any nucleic acid
accnnnnnnnnnnnnnnnnnggc

SEQ ID NO: 754 - DNA, 12 bp, Artificial Sequence
  Dyad patterns over-represented in STAR elements
  misc_feature (4)..(9): the `n' at positions 4-9 may be any nucleic acid
cccnnnnnncga

SEQ ID NO: 755 - DNA, 16 bp, Artificial Sequence
  Dyad patterns over-represented in STAR elements
  misc_feature (4)..(13): the `n' at positions 4-13 may be any nucleic acid
aagnnnnnnnnnncgg

SEQ ID NO: 756 - DNA, 23 bp, Artificial Sequence
  Dyad patterns over-represented in STAR elements
  misc_feature (4)..(20): the `n' at positions 4-20 may be any nucleic acid
cgcnnnnnnnnnnnnnnnnncac

SEQ ID NO: 757 - DNA, 22 bp, Artificial Sequence
  Dyad patterns over-represented in STAR elements
  misc_feature (4)..(19): the `n' at positions 4-19 may be any nucleic acid
cccnnnnnnnnnnnnnnnncgg

SEQ ID NO: 758 - DNA, 24 bp, Artificial Sequence
  Dyad patterns over-represented in STAR elements
  misc_feature (4)..(21): the `n' at positions 4-21 may be any nucleic acid
gacnnnnnnnnnnnnnnnnnnggc

SEQ ID NO: 759 - DNA, 21 bp, Artificial Sequence
  Dyad patterns over-represented in STAR elements
  misc_feature (4)..(18): the `n' at positions 4-18 may be any nucleic acid
gggnnnnnnnnnnnnnnngac

SEQ ID NO: 760 - DNA, 10 bp, Artificial Sequence
  Dyad patterns over-represented in STAR elements
  misc_feature (4)..(7): the `n' at positions 4-7 may be any nucleic acid
gccnnnntcc

SEQ ID NO: 761 - DNA, 21 bp, Artificial Sequence
  Dyad patterns over-represented in STAR elements
  misc_feature (4)..(18): the `n' at positions 4-18 may be any nucleic acid
ggcnnnnnnnnnnnnnnnccc

SEQ ID NO: 762 - DNA, 18 bp, Artificial Sequence
  Dyad patterns over-represented in STAR elements
  misc_feature (4)..(15): the `n' at positions 4-15 may be any nucleic acid
cagnnnnnnnnnnnncgc

SEQ ID NO: 763 - DNA, 9 bp, Artificial Sequence
  Dyad patterns over-represented in STAR elements
  misc_feature (4)..(6): the `n' at positions 4-6 may be any nucleic acid
ccannngcg

SEQ ID NO: 764 - DNA, 22 bp, Artificial Sequence
  Dyad patterns over-represented in STAR elements
  misc_feature (4)..(19): the `n' at positions 4-19 may be any nucleic acid
ccgnnnnnnnnnnnnnnnngag

SEQ ID NO: 765 - DNA, 8 bp, Artificial Sequence
  Dyad patterns over-represented in STAR elements
  misc_feature (4)..(5): the `n' at positions 4-5 may be any nucleic acid
agcnncgc

SEQ ID NO: 766 - DNA, 10 bp, Artificial Sequence
  Dyad patterns over-represented in STAR elements
  misc_feature (4)..(7): the `n' at positions 4-7 may be any nucleic acid
gagnnnnccc

SEQ ID NO: 767 - DNA, 9 bp, Artificial Sequence
  Dyad patterns over-represented in STAR elements
  misc_feature (4)..(6): the `n' at positions 4-6 may be any nucleic acid
aggnnncgc

SEQ ID NO: 768 - DNA, 19 bp, Artificial Sequence
  Dyad patterns over-represented in STAR elements
  misc_feature (4)..(16): the `n' at positions 4-16 may be any nucleic acid
cacnnnnnnnnnnnnnagg

SEQ ID NO: 769 - DNA, 10 bp, Artificial Sequence
  Dyad patterns over-represented in STAR elements
  misc_feature (4)..(7): the `n' at positions 4-7 may be any nucleic acid
cccnnnncag

SEQ ID NO: 770 - DNA, 8 bp, Artificial Sequence
  Dyad patterns over-represented in STAR elements
  misc_feature (4)..(5): the `n' at positions 4-5 may be any nucleic acid
cccnngaa

SEQ ID NO: 771 - DNA, 25 bp, Artificial Sequence
  Dyad patterns over-represented in STAR elements
  misc_feature (4)..(22): the `n' at positions 4-22 may be any nucleic acid
cgcnnnnnnnnnnnnnnnnnnngag

SEQ ID NO: 772 - DNA, 24 bp, Artificial Sequence
  Dyad patterns over-represented in STAR elements
  misc_feature (4)..(21): the `n' at positions 4-21 may be any nucleic acid
acgnnnnnnnnnnnnnnnnnnggg

SEQ ID NO: 773 - DNA, 10 bp, Artificial Sequence
  Dyad patterns over-represented in STAR elements
  misc_feature (4)..(7): the `n' at positions 4-7 may be any nucleic acid
cccnnnnggc

SEQ ID NO: 774 - DNA, 15 bp, Artificial Sequence
  Dyad patterns over-represented in STAR elements
  misc_feature (4)..(12): the `n' at positions 4-12 may be any nucleic acid
cggnnnnnnnnngag

SEQ ID NO: 775 - DNA, 9 bp, Artificial Sequence
  Dyad patterns over-represented in STAR elements
  misc_feature (4)..(6): the `n' at positions 4-6 may be any nucleic acid
cccnnnggg

SEQ ID NO: 776 - DNA, 10 bp, Artificial Sequence
  Dyad patterns over-represented in STAR elements
  misc_feature (4)..(7): the `n' at positions 4-7 may be any nucleic acid
gagnnnnggc

SEQ ID NO: 777 - DNA, 11 bp, Artificial Sequence
  Dyad patterns over-represented in STAR elements
  misc_feature (4)..(8): the `n' at positions 4-8 may be any nucleic acid
cgcnnnnngag

SEQ ID NO: 778 - DNA, 26 bp, Artificial Sequence
  Dyad patterns over-represented in STAR elements
  misc_feature (4)..(23): the `n' at positions 4-23 may be any nucleic acid
ccgnnnnnnnnnnnnnnnnnnnnagg

SEQ ID NO: 779 - DNA, 21 bp, Artificial Sequence
  Dyad patterns over-represented in STAR elements
  misc_feature (4)..(18): the `n' at positions 4-18 may be any nucleic acid
cccnnnnnnnnnnnnnnnccc

SEQ ID NO: 780 - DNA, 23 bp, Artificial Sequence
  Dyad patterns over-represented in STAR elements
  misc_feature (4)..(20): the `n' at positions 4-20 may be any nucleic acid
aggnnnnnnnnnnnnnnnnnccg

SEQ ID NO: 781 - DNA, 12 bp, Artificial Sequence
  Dyad patterns over-represented in STAR elements
  misc_feature (4)..(9): the `n' at positions 4-9 may be any nucleic acid
aggnnnnnnggg

SEQ ID NO: 782 - DNA, 26 bp, Artificial Sequence
  Dyad patterns over-represented in STAR elements
  misc_feature (4)..(23): the `n' at positions 4-23 may be any nucleic acid
ggcnnnnnnnnnnnnnnnnnnnnccc

SEQ ID NO: 783 - DNA, 23 bp, Artificial Sequence
  Dyad patterns over-represented in STAR elements
  misc_feature (4)..(20): the `n' at positions 4-20 may be any nucleic acid
gcannnnnnnnnnnnnnnnncgc

SEQ ID NO: 784 - DNA, 17 bp, Artificial Sequence
  Dyad patterns over-represented in STAR elements
  misc_feature (4)..(14): the `n' at positions 4-14 may be any nucleic acid
cgannnnnnnnnnnacg

SEQ ID NO: 785 - DNA, 8 bp, Artificial Sequence
  Dyad patterns over-represented in STAR elements
  misc_feature (4)..(5): the `n' at positions 4-5 may be any nucleic acid
cgcnngga

SEQ ID NO: 786 - DNA, 11 bp, Artificial Sequence
  Dyad patterns over-represented in STAR elements
  misc_feature (4)..(8): the `n' at positions 4-8 may be any nucleic acid
ctgnnnnnccc

SEQ ID NO: 787 - DNA, 26 bp, Artificial Sequence
  Dyad patterns over-represented in STAR elements
  misc_feature (4)..(23): the `n' at positions 4-23 may be any nucleic acid
tccnnnnnnnnnnnnnnnnnnnncca

SEQ ID NO: 788 - DNA, 8 bp, Artificial Sequence
  Dyad patterns over-represented in STAR elements
  misc_feature (4)..(5): the `n' at positions 4-5 may be any nucleic acid
ccannggg

SEQ ID NO: 789 - DNA, 21 bp, Artificial Sequence
  Dyad patterns over-represented in STAR elements
  misc_feature (4)..(18): the `n' at positions 4-18 may be any nucleic acid
ccgnnnnnnnnnnnnnnngcg

SEQ ID NO: 790 - DNA, 11 bp, Artificial Sequence
  Dyad patterns over-represented in STAR elements
  misc_feature (4)..(8): the `n' at positions 4-8 may be any nucleic acid
ccannnnnggg

SEQ ID NO: 791 - DNA, 7 bp, Artificial Sequence
  Dyad patterns over-represented in STAR elements
  misc_feature (4)..(4): the `n' at position 4 may be any nucleic acid
cggntgc

SEQ ID NO: 792 - DNA, 20 bp, Artificial Sequence
  Dyad patterns over-represented in STAR elements
  misc_feature (4)..(17): the `n' at positions 4-17 may be any nucleic acid
cccnnnnnnnnnnnnnngcg

SEQ ID NO: 793 - DNA, 6 bp, Artificial Sequence
  Dyad patterns over-represented in STAR elements
cagccg

SEQ ID NO: 794 - DNA, 15 bp, Artificial Sequence
  Dyad patterns over-represented in STAR elements
  misc_feature (4)..(12): the `n' at positions 4-12 may be any nucleic acid
gccnnnnnnnnntcc

SEQ ID NO: 795 - DNA, 26 bp, Artificial Sequence
  Dyad patterns over-represented in STAR elements
  misc_feature (4)..(23): the `n' at positions 4-23 may be any nucleic acid
aggnnnnnnnnnnnnnnnnnnnncgc

SEQ ID NO: 796 - DNA, 12 bp, Artificial Sequence
  Dyad patterns over-represented in STAR elements
  misc_feature (4)..(9): the `n' at positions 4-9 may be any nucleic acid
cccnnnnnngac

SEQ ID NO: 797 - DNA, 17 bp, Artificial Sequence
  Dyad patterns over-represented in STAR elements
  misc_feature (4)..(14): the `n' at positions 4-14 may be any nucleic acid
cggnnnnnnnnnnncca

SEQ ID NO: 798 - DNA, 20 bp, Artificial Sequence
  Dyad patterns over-represented in STAR elements
  misc_feature (4)..(17): the `n' at positions 4-17 may be any nucleic acid
gggnnnnnnnnnnnnnncac

SEQ ID NO: 799 - DNA, 21 bp, Artificial Sequence
  Dyad patterns over-represented in STAR elements
  misc_feature (4)..(18): the `n' at positions 4-18 may be any nucleic acid
gcannnnnnnnnnnnnnncgc

SEQ ID NO: 800 - DNA, 8 bp, Artificial Sequence
  Dyad patterns over-represented in STAR elements
  misc_feature (4)..(5): the `n' at positions 4-5 may be any nucleic acid
cgcnnaca

SEQ ID NO: 801 - DNA, 15 bp, Artificial Sequence
  Dyad patterns over-represented in STAR elements
  misc_feature (4)..(12): the `n' at positions 4-12 may be any nucleic acid
accnnnnnnnnnccc

SEQ ID NO: 802 - DNA, 15 bp, Artificial Sequence
  Dyad patterns over-represented in STAR elements
  misc_feature (4)..(12): the `n' at positions 4-12 may be any nucleic acid
gcgnnnnnnnnncgc

SEQ ID NO: 803 - DNA, 21 bp, Artificial Sequence
  Dyad patterns over-represented in STAR elements
  misc_feature (4)..(18): the `n' at positions 4-18 may be any nucleic acid
cagnnnnnnnnnnnnnnngcg

SEQ ID NO: 804 - DNA, 24 bp, Artificial Sequence
  Dyad patterns over-represented in STAR elements
  misc_feature (4)..(21): the `n' at positions 4-21 may be any nucleic acid
cccnnnnnnnnnnnnnnnnnngtc

SEQ ID NO: 805 - DNA, 9 bp, Artificial Sequence
  Dyad patterns over-represented in STAR elements
  misc_feature (4)..(6): the `n' at positions 4-6 may be any nucleic acid
gcgnnnccc

SEQ ID NO: 806 - DNA, 17 bp, Artificial Sequence
  Dyad patterns over-represented in STAR elements
  misc_feature (4)..(14): the `n' at positions 4-14 may be any nucleic acid
cggnnnnnnnnnnngcc

SEQ ID NO: 807 - DNA, 7 bp, Artificial Sequence
  Dyad patterns over-represented in STAR elements
  misc_feature (4)..(4): the `n' at position 4 may be any nucleic acid
cccncgg

SEQ ID NO: 808 - DNA, 10 bp, Artificial Sequence
  Dyad patterns over-represented in STAR elements
  misc_feature (4)..(7): the `n' at positions 4-7 may be any nucleic acid
gccnnnncca

SEQ ID NO: 809 - DNA, 10 bp, Artificial Sequence
  Dyad patterns over-represented in STAR elements
  misc_feature (4)..(7): the `n' at positions 4-7 may be any nucleic acid
cccnnnnccg

SEQ ID NO: 810 - DNA, 8 bp, Artificial Sequence
  Dyad patterns over-represented in STAR elements
  misc_feature (4)..(5): the `n' at positions 4-5 may be any nucleic acid
cgtnngca

SEQ ID NO: 811 - DNA, 13 bp, Artificial Sequence
  Dyad patterns over-represented in STAR elements
  misc_feature (4)..(10): the `n' at positions 4-10 may be any nucleic acid
agcnnnnnnntcg

SEQ ID NO: 812 - DNA, 21 bp, Artificial Sequence
  Dyad patterns over-represented in STAR elements
  misc_feature (4)..(18): the `n' at positions 4-18 may be any nucleic acid
ccgnnnnnnnnnnnnnnngaa

SEQ ID NO: 813 - DNA, 11 bp, Artificial Sequence
  Dyad patterns over-represented in STAR elements
  misc_feature (4)..(8): the `n' at positions 4-8 may be any nucleic acid
accnnnnnccc

SEQ ID NO: 814 - DNA, 20 bp, Artificial Sequence
  Dyad patterns over-represented in STAR elements
  misc_feature (4)..(17): the `n' at positions 4-17 may be any nucleic acid
cgcnnnnnnnnnnnnnngag

SEQ ID NO: 815 - DNA, 13 bp, Artificial Sequence
  Dyad patterns over-represented in STAR elements
  misc_feature (4)..(10): the `n' at positions 4-10 may be any nucleic acid
cccnnnnnnncgc

SEQ ID NO: 816 - DNA, 18 bp, Artificial Sequence
  Dyad patterns over-represented in STAR elements
  misc_feature (4)..(15): the `n' at positions 4-15 may be any nucleic acid
gagnnnnnnnnnnnncgc

SEQ ID NO: 817 - DNA, 23 bp, Artificial Sequence
  Dyad patterns over-represented in STAR elements
  misc_feature (4)..(20): the `n' at positions 4-20 may be any nucleic acid
ggcnnnnnnnnnnnnnnnnnccc

SEQ ID NO: 818 - DNA, 17 bp, Artificial Sequence
  Dyad patterns over-represented in STAR elements
  misc_feature (4)..(14): the `n' at positions 4-14 may be any nucleic acid
acgnnnnnnnnnnnctc

SEQ ID NO: 819 - DNA, 15 bp, Artificial Sequence
  Dyad patterns over-represented in STAR elements
  misc_feature (4)..(12): the `n' at positions 4-12 may be any nucleic acid
acannnnnnnnncgg

SEQ ID NO: 820 - DNA, 13 bp, Artificial Sequence
  Dyad patterns over-represented in STAR elements
  misc_feature (4)..(10): the `n' at positions 4-10 may be any nucleic acid
ctgnnnnnnnccc

SEQ ID NO: 821 - DNA, 8 bp, Artificial Sequence
  Dyad patterns over-represented in STAR elements
  misc_feature (4)..(5): the `n' at positions 4-5 may be any nucleic acid
cccnngcc

SEQ ID NO: 822 - DNA, 8 bp, Artificial Sequence
  Dyad patterns over-represented in STAR elements
  misc_feature (4)..(5): the `n' at positions 4-5 may be any nucleic acid
cggnngca

SEQ ID NO: 823 - DNA, 6 bp, Artificial Sequence
  Dyad patterns over-represented in STAR elements
ccctgc

SEQ ID NO: 824 - DNA, 13 bp, Artificial Sequence
  Dyad patterns over-represented in STAR elements
  misc_feature (4)..(10): the `n' at positions 4-10 may be any nucleic acid
cgcnnnnnnnacc

SEQ ID NO: 825 - DNA, 8 bp, Artificial Sequence
  Dyad patterns over-represented in STAR elements
  misc_feature (4)..(5): the `n' at positions 4-5 may be any nucleic acid
gcanngcc

SEQ ID NO: 826 - DNA, 14 bp, Artificial Sequence
  Dyad patterns over-represented in STAR elements
  misc_feature (4)..(11): the `n' at positions 4-11 may be any nucleic acid
gcgnnnnnnnncca

SEQ ID NO: 827 - DNA, 6 bp, Artificial Sequence
  Dyad patterns over-represented in STAR elements
agccgc

SEQ ID NO: 828 - DNA, 8 bp, Artificial Sequence
  Dyad patterns over-represented in STAR elements
  misc_feature (4)..(5): the `n' at positions 4-5 may be any nucleic acid
gcgnngca

SEQ ID NO: 829 - DNA, 8 bp, Artificial Sequence
  Dyad patterns over-represented in STAR elements
  misc_feature (4)..(5): the `n' at positions 4-5 may be any nucleic acid
ccgnngtc

SEQ ID NO: 830 - DNA, 9 bp, Artificial Sequence
  Dyad patterns over-represented in STAR elements
  misc_feature (4)..(6): the `n' at positions 4-6 may be any nucleic acid
ccgnnnaca

SEQ ID NO: 831 - DNA, 19 bp, Artificial Sequence
  Dyad patterns over-represented in STAR elements
  misc_feature (4)..(16): the `n' at positions 4-16 may be any nucleic acid
acgnnnnnnnnnnnnntgg

SEQ ID NO: 832 - DNA, 14 bp, Artificial Sequence
  Dyad patterns over-represented in STAR elements
  misc_feature (4)..(11): the `n' at positions 4-11 may be any nucleic acid
ccannnnnnnncgc

SEQ ID NO: 833 - DNA, 15 bp, Artificial Sequence
  Dyad patterns over-represented in STAR elements
  misc_feature (4)..(12): the `n' at positions 4-12 may be any nucleic acid
ccgnnnnnnnnnggc

SEQ ID NO: 834 - DNA, 11 bp, Artificial Sequence
  Dyad patterns over-represented in STAR elements
  misc_feature (4)..(8): the `n' at positions 4-8 may be any nucleic acid
ccannnnnccg

SEQ ID NO: 835 - DNA, 9 bp, Artificial Sequence
  Dyad patterns over-represented in STAR elements
  misc_feature (4)..(6): the `n' at positions 4-6 may be any nucleic acid
aggnnnggg

SEQ ID NO: 836 - DNA, 8 bp, Artificial Sequence
  Dyad patterns over-represented in STAR elements
  misc_feature (4)..(5): the `n' at positions 4-5 may be any nucleic acid
cagnnggc

SEQ ID NO: 837 - DNA, 14 bp, Artificial Sequence
  Dyad patterns over-represented in STAR elements
  misc_feature (4)..(11): the `n' at positions 4-11 may be any nucleic acid
cccnnnnnnnncag

SEQ ID NO: 838 - DNA, 11 bp, Artificial Sequence
  Dyad patterns over-represented in STAR elements
  misc_feature (4)..(8): the `n' at positions 4-8 may be any nucleic acid
agcnnnnncag

SEQ ID NO: 839 - DNA, 22 bp, Artificial Sequence
  Dyad patterns over-represented in STAR elements
  misc_feature (4)..(19): the `n' at positions 4-19 may be any nucleic acid
cggnnnnnnnnnnnnnnnngcc

SEQ ID NO: 840 - DNA, 21 bp, Artificial Sequence
  Dyad patterns over-represented in STAR elements
  misc_feature (4)..(18): the `n' at positions 4-18 may be any nucleic acid
gcgnnnnnnnnnnnnnnnccc

SEQ ID NO: 841 - DNA, 17 bp, Artificial Sequence
  Dyad patterns over-represented in STAR elements
  misc_feature (4)..(14): the `n' at positions 4-14 may be any nucleic acid
cccnnnnnnnnnnngcc

SEQ ID NO: 842 - DNA, 8 bp, Artificial Sequence
  Dyad patterns over-represented in STAR elements
  misc_feature (4)..(5): the `n' at positions 4-5 may be any nucleic acid
cgannacg

SEQ ID NO: 843 - DNA, 10 bp, Artificial Sequence
  Dyad patterns over-represented in STAR elements
  misc_feature (4)..(7): the `n' at positions 4-7 may be any nucleic acid
cggnnnngcc

SEQ ID NO: 844 - DNA, 12 bp, Artificial Sequence
  Dyad patterns over-represented in STAR elements
  misc_feature (4)..(9): the `n' at positions 4-9 may be any nucleic acid
cacnnnnnncgc

SEQ ID NO: 845 - DNA, 11 bp, Artificial Sequence
  Dyad patterns over-represented in STAR elements
  misc_feature (4)..(8): the `n' at positions 4-8 may be any nucleic acid
cggnnnnnacg

SEQ ID NO: 846 - DNA, 10 bp, Artificial Sequence
  Dyad patterns over-represented in STAR elements
  misc_feature (4)..(7): the `n' at positions 4-7 may be any nucleic acid
ctgnnnngcc

SEQ ID NO: 847 - DNA, 24 bp, Artificial Sequence
  Dyad patterns over-represented in STAR elements
  misc_feature (4)..(21): the `n' at positions 4-21 may be any nucleic acid
gggnnnnnnnnnnnnnnnnnncga

SEQ ID NO: 848 - DNA, 14 bp, Artificial Sequence
  Dyad patterns over-represented in STAR elements
  misc_feature (4)..(11): the `n' at positions 4-11 may be any nucleic acid
cctnnnnnnnncgc

SEQ ID NO: 849 - DNA, 10 bp, Artificial Sequence
  Dyad patterns over-represented in STAR elements
  misc_feature (4)..(7): the `n' at positions 4-7 may be any nucleic acid
gccnnnnccc

SEQ ID NO: 850 - DNA, 16 bp, Artificial Sequence
  Dyad patterns over-represented in STAR elements
  misc_feature (4)..(13): the `n' at positions 4-13 may be any nucleic acid
cggnnnnnnnnnngcc

SEQ ID NO: 851 - DNA, 11 bp, Artificial Sequence
  Dyad patterns over-represented in STAR elements
  misc_feature (4)..(8): the `n' at positions 4-8 may be any nucleic acid
gccnnnnngga

SEQ ID NO: 852 - DNA, 13 bp, Artificial Sequence
  Dyad patterns over-represented in STAR elements
  misc_feature (4)..(10): the `n' at positions 4-10 may be any nucleic acid
accnnnnnnngcg

SEQ ID NO: 853 - DNA, 14 bp, Artificial Sequence
  Dyad patterns over-represented in STAR elements
  misc_feature (4)..(11): the `n' at positions 4-11 may be any nucleic acid
cccnnnnnnnncgc

SEQ ID NO: 854 - DNA, 11 bp, Artificial Sequence
  Dyad patterns over-represented in STAR elements
  misc_feature (4)..(8): the `n' at positions 4-8 may be any nucleic acid
cagnnnnnccc

SEQ ID NO: 855 - DNA, 20 bp, Artificial Sequence
  Dyad patterns over-represented in STAR elements
  misc_feature (4)..(17): the `n' at positions 4-17 may be any nucleic acid
cacnnnnnnnnnnnnnngga

SEQ ID NO: 856 - DNA, 7 bp, Artificial Sequence
  Dyad patterns over-represented in STAR elements
  misc_feature (4)..(4): the `n' at position 4 may be any nucleic acid
cccngcc

SEQ ID NO: 857 - DNA, 11 bp, Artificial Sequence
  Dyad patterns over-represented in STAR elements
  misc_feature (4)..(8): the `n' at positions 4-8 may be any nucleic acid
cccnnnnnagc

SEQ ID NO: 858 - DNA, 11 bp, Artificial Sequence
  Dyad patterns over-represented in STAR elements
  misc_feature (4)..(8): the `n' at positions 4-8 may be any nucleic acid
ggcnnnnngga

SEQ ID NO: 859 - DNA, 23 bp, Artificial Sequence
  Dyad patterns over-represented in STAR elements
  misc_feature (4)..(20): the `n' at positions 4-20 may be any nucleic acid
cgannnnnnnnnnnnnnnnngag

SEQ ID NO: 860 - DNA, 13 bp, Artificial Sequence
  Dyad patterns over-represented in STAR elements
  misc_feature (4)..(10): the `n' at positions 4-10 may be any nucleic acid
cgcnnnnnnnaca

SEQ ID NO: 861 - DNA, 19 bp, Artificial Sequence
  Dyad patterns over-represented in STAR elements
  misc_feature (4)..(16): the `n' at positions 4-16 may be any nucleic acid
ccannnnnnnnnnnnnccc

SEQ ID NO: 862 - DNA, 26 bp, Artificial Sequence
  Dyad patterns over-represented in STAR elements
  misc_feature (4)..(23): the `n' at positions 4-23 may be any nucleic acid
cggnnnnnnnnnnnnnnnnnnnnggc

SEQ ID NO: 863 - DNA, 23 bp, Artificial Sequence
  Dyad patterns over-represented in STAR elements
  misc_feature (4)..(20): the `n' at positions 4-20 may be any nucleic acid
cccnnnnnnnnnnnnnnnnngcc

SEQ ID NO: 864 - DNA, 16 bp, Artificial Sequence
  Dyad patterns over-represented in STAR elements
  misc_feature (4)..(13): the `n' at positions 4-13 may be any nucleic acid
cctnnnnnnnnnnccg

SEQ ID NO: 865 - DNA, 14 bp, Artificial Sequence
  Dyad patterns over-represented in STAR elements
  misc_feature (4)..(11): the `n' at positions 4-11 may be any nucleic acid
cccnnnnnnnnccg

SEQ ID NO: 866 - DNA, 9 bp, Artificial Sequence
  Dyad patterns over-represented in STAR elements
  misc_feature (4)..(6): the `n' at positions 4-6 may be any nucleic acid
cgcnnngag

SEQ ID NO: 867 - DNA, 13 bp, Artificial Sequence
  Dyad patterns over-represented in STAR elements
  misc_feature (4)..(10): the `n' at positions 4-10 may be any nucleic acid
cgcnnnnnnnaag

SEQ ID NO: 868 - DNA, 17 bp, Artificial Sequence
  Dyad patterns over-represented in STAR elements
  misc_feature (4)..(14): the `n' at positions 4-14 may be any nucleic acid
cggnnnnnnnnnnngga

SEQ ID NO: 869 - DNA, 21 bp, Artificial Sequence
  Dyad patterns over-represented in STAR elements
  misc_feature (4)..(18): the `n' at positions 4-18 may be any nucleic acid
ccgnnnnnnnnnnnnnnnccg

SEQ ID NO: 870 - DNA, 9 bp, Artificial Sequence
  Dyad patterns over-represented in STAR elements
  misc_feature (4)..(6): the `n' at positions 4-6 may be any nucleic acid
cccnnngca

SEQ ID NO: 871 - DNA, 8 bp, Artificial Sequence
  Dyad patterns over-represented in STAR elements
  misc_feature (4)..(5): the `n' at positions 4-5 may be any nucleic acid
cggnncag

SEQ ID NO: 872 - DNA, 8 bp, Artificial Sequence
  Dyad patterns over-represented in STAR elements
  misc_feature (4)..(5): the `n' at positions 4-5 may be any nucleic acid
aggnnccg

SEQ ID NO: 873 - DNA, 10 bp, Artificial Sequence
  Dyad patterns over-represented in STAR elements
  misc_feature (4)..(7): the `n' at positions 4-7 may be any nucleic acid
cccnnnncac

SEQ ID NO: 874 - DNA, 25 bp, Artificial Sequence
  Dyad patterns over-represented in STAR elements
  misc_feature (4)..(22): the `n' at positions 4-22 may be any nucleic acid
ggannnnnnnnnnnnnnnnnnnccc

SEQ ID NO: 875 - DNA, 14 bp, Artificial Sequence
  Dyad patterns over-represented in STAR elements
  misc_feature (4)..(11): the `n' at positions 4-11 may be any nucleic acid
cccnnnnnnnncac

SEQ ID NO: 876 - DNA, 12 bp, Artificial Sequence
  Dyad patterns over-represented in STAR elements
  misc_feature (4)..(9): the `n' at positions 4-9 may be any nucleic acid
accnnnnnnccg

SEQ ID NO: 877 - DNA, 12 bp, Artificial Sequence
  Dyad patterns over-represented in STAR elements
  misc_feature (4)..(9): "N" stands for any nucleic acid
cccnnnnnnggc

SEQ ID NO: 878 - DNA, 12 bp, Artificial Sequence
  Dyad patterns over-represented in STAR elements
  misc_feature (4)..(9): the `n' at positions 4-9 may be any nucleic acid
cccnnnnnnccg

SEQ ID NO: 879 - DNA, 20 bp, Artificial Sequence
  Dyad patterns over-represented in STAR elements
  misc_feature (4)..(17): the `n' at positions 4-17 may be any nucleic acid
cgcnnnnnnnnnnnnnngcc

SEQ ID NO: 880 - DNA, 11 bp, Artificial Sequence
  Dyad patterns over-represented in STAR elements
  misc_feature (4)..(8): the `n' at positions 4-8 may be any nucleic acid
ccgnnnnntcc

SEQ ID NO: 881 - DNA, 12 bp, Artificial Sequence
  Dyad patterns over-represented in STAR elements
  misc_feature (4)..(9): the `n' at positions 4-9 may be any nucleic acid
gccnnnnnngcc

SEQ ID NO: 882 - DNA, 13 bp, Artificial Sequence
  Dyad patterns over-represented in STAR elements
  misc_feature (4)..(10): the `n' at positions 4-10 may be any nucleic acid
cggnnnnnnngga

SEQ ID NO: 883 - DNA, 12 bp, Artificial Sequence
  Dyad patterns over-represented in STAR elements
  misc_feature (4)..(9): the `n' at positions 4-9 may be any nucleic acid
gggnnnnnngga

SEQ ID NO: 884 - DNA, 18 bp, Artificial Sequence
  Dyad patterns over-represented in STAR elements
  misc_feature (4)..(15): the `n' at positions 4-15 may be any nucleic acid
gccnnnnnnnnnnnntcc

SEQ ID NO: 885 - DNA, 22 bp, Artificial Sequence
  Dyad patterns over-represented in STAR elements
  misc_feature (4)..(19): the `n' at positions 4-19 may be any nucleic acid
agtnnnnnnnnnnnnnnnnccg

SEQ ID NO: 886 - DNA, 25 bp, Artificial Sequence
  Dyad patterns over-represented in STAR elements
  misc_feature (4)..(22): the `n' at positions 4-22 may be any nucleic acid
ggcnnnnnnnnnnnnnnnnnnngcc

SEQ ID NO: 887 - DNA, 9 bp, Artificial Sequence
  Dyad patterns over-represented in STAR elements
  misc_feature (4)..(6): the `n' at positions 4-6 may be any nucleic acid
ccgnnnccg

SEQ ID NO: 888 - DNA, 14 bp, Artificial Sequence
  Dyad patterns over-represented in STAR elements
  misc_feature (4)..(11): the `n' at positions 4-11 may be any nucleic acid
cccnnnnnnnnacc

SEQ ID NO: 889 - DNA, 21 bp, Artificial Sequence
  Dyad patterns over-represented in STAR elements
  misc_feature (4)..(18): the `n' at positions 4-18 may be any nucleic acid
cagnnnnnnnnnnnnnnngcc

SEQ ID NO: 890 - DNA, 23 bp, Artificial Sequence
  Dyad patterns over-represented in STAR elements
  misc_feature (4)..(20): the `n' at positions 4-20 may be any nucleic acid
cccnnnnnnnnnnnnnnnnncgg

SEQ ID NO: 891 - DNA, 7 bp, Artificial Sequence
  Dyad patterns over-represented in STAR elements
  misc_feature (4)..(4): the `n' at position 4 may be any nucleic acid
gcgncca

SEQ ID NO: 892 - DNA, 20 bp, Artificial Sequence
  Dyad patterns over-represented in STAR elements
  misc_feature (4)..(17): the `n' at positions 4-17 may be any nucleic acid
cccnnnnnnnnnnnnnncag

SEQ ID NO: 893 - DNA, 14 bp, Artificial Sequence
  Dyad patterns over-represented in STAR elements
  misc_feature (4)..(11): the `n' at positions 4-11 may be any nucleic acid
cccnnnnnnnnccc

SEQ ID NO: 894 - DNA, 18 bp, Artificial Sequence
  Dyad patterns over-represented in STAR elements
  misc_feature (4)..(15): the `n' at positions 4-15 may be any nucleic acid
acannnnnnnnnnnngcg

SEQ ID NO: 895 - DNA, 10 bp, Artificial Sequence
  Dyad patterns over-represented in STAR elements
  misc_feature (4)..(7): the `n' at positions 4-7 may be any nucleic acid
aggnnnnccg

SEQ ID NO: 896 - DNA, 19 bp, Artificial Sequence
  Dyad patterns over-represented in STAR elements
  misc_feature (4)..(16): the `n' at positions 4-16 may be any nucleic acid
cgcnnnnnnnnnnnnngcc

SEQ ID NO: 897 - DNA, 8 bp, Artificial Sequence
  Dyad patterns over-represented in STAR elements
  misc_feature (4)..(5): the `n' at positions 4-5 may be any nucleic acid
gagnncgc

SEQ ID NO: 898 - DNA, 15 bp, Artificial Sequence
  Dyad patterns over-represented in STAR elements
  misc_feature (4)..(12): the `n' at positions 4-12 may be any nucleic acid
cccnnnnnnnnngcg

SEQ ID NO: 899 - DNA, 23 bp, Artificial Sequence
  Dyad patterns over-represented in STAR elements
  misc_feature (4)..(20): the `n' at positions 4-20 may be any nucleic acid
cgcnnnnnnnnnnnnnnnnnaca

SEQ ID NO: 900 - DNA, 23 bp, Artificial Sequence
  Dyad patterns over-represented in STAR elements
  misc_feature (4)..(20): the `n' at positions 4-20 may be any nucleic acid
gcgnnnnnnnnnnnnnnnnncca

SEQ ID NO: 901 - DNA, 24 bp, Artificial Sequence
  Dyad patterns over-represented in STAR elements
  misc_feature (4)..(21): the `n' at positions 4-21 may be any nucleic acid
aagnnnnnnnnnnnnnnnnnnccg

SEQ ID NO: 902 - DNA, 7 bp, Artificial Sequence
  Dyad patterns over-represented in STAR elements
  misc_feature (4)..(4): the `n' at position 4 may be any nucleic acid
cgcngga

SEQ ID NO: 903 - DNA, 7 bp, Artificial Sequence
  Dyad patterns over-represented in STAR elements
  misc_feature (4)..(4): the `n' at position 4 may be any nucleic acid
ccanccc

SEQ ID NO: 904 - DNA, 24 bp, Artificial Sequence
  Dyad patterns over-represented in STAR elements
  misc_feature (4)..(21): the `n' at positions 4-21 may be any nucleic acid
cgtnnnnnnnnnnnnnnnnnntgc

SEQ ID NO: 905 - DNA, 20 bp, Artificial Sequence
  Dyad patterns over-represented in STAR elements
  misc_feature (4)..(17): the `n' at positions 4-17 may be any nucleic acid
tccnnnnnnnnnnnnnncga

SEQ ID NO: 906 - DNA, 11 bp, Artificial Sequence
  Dyad patterns over-represented in STAR elements
  misc_feature (4)..(8): the `n' at positions 4-8 may be any nucleic acid
cacnnnnnggg

SEQ ID NO: 907 - DNA, 18 bp, Artificial Sequence
  Dyad patterns over-represented in STAR elements
  misc_feature (4)..(15): the `n' at positions 4-15 may be any nucleic acid
ccgnnnnnnnnnnnngca

SEQ ID NO: 908 - DNA, 12 bp, Artificial Sequence
  Dyad patterns over-represented in STAR elements
  misc_feature (4)..(9): the `n' at positions 4-9 may be any nucleic acid
ctgnnnnnnccc

SEQ ID NO: 909 - DNA, 14 bp, Artificial Sequence
  Dyad patterns over-represented in STAR elements
  misc_feature (4)..(11): the `n' at positions 4-11 may be any nucleic acid
cggnnnnnnnnggc

SEQ ID NO: 910 - DNA, 17 bp, Artificial Sequence
  Dyad patterns over-represented in STAR elements
  misc_feature (4)..(14): the `n' at positions 4-14 may be any nucleic acid
ccannnnnnnnnnnggg

SEQ ID NO: 911 - DNA, 25 bp, Artificial Sequence
  Dyad patterns over-represented in STAR elements
  misc_feature (4)..(22): the `n' at positions 4-22 may be any nucleic acid
acgnnnnnnnnnnnnnnnnnnncaa

SEQ ID NO: 912 - DNA, 26 bp, Artificial Sequence
  Dyad patterns over-represented in STAR elements
  misc_feature (4)..(23): the `n' at positions 4-23 may be any nucleic acid
gggnnnnnnnnnnnnnnnnnnnnccc

SEQ ID NO: 913 - DNA, 10 bp, Artificial Sequence
  Dyad patterns over-represented in STAR elements
  misc_feature (4)..(7): the `n' at positions 4-7 may be any nucleic acid
cgcnnnncag

SEQ ID NO: 914 - DNA, 23 bp, Artificial Sequence
  Dyad patterns over-represented in STAR elements
  misc_feature (4)..(20): the `n' at positions 4-20 may be any nucleic acid
agcnnnnnnnnnnnnnnnnnggg

SEQ ID NO: 915 - DNA, 26 bp, Artificial Sequence
  Dyad patterns over-represented in STAR elements
  misc_feature (4)..(23): the `n' at positions 4-23 may be any nucleic acid
cacnnnnnnnnnnnnnnnnnnnnccg

SEQ ID NO: 916 - DNA, 23 bp, Artificial Sequence
  Dyad patterns over-represented in STAR elements
  misc_feature (4)..(20): the `n' at positions 4-20 may be any nucleic acid
acgnnnnnnnnnnnnnnnnncag

SEQ ID NO: 917 - DNA, 7 bp, Artificial Sequence
  Dyad patterns over-represented in STAR elements
  misc_feature (4)..(4): the `n' at position 4 may be any nucleic acid
aggnccc

SEQ ID NO: 918 - DNA, 18 bp, Artificial Sequence
  Dyad patterns over-represented in STAR elements
  misc_feature (4)..(15): the `n' at positions 4-15 may be any nucleic acid
cgtnnnnnnnnnnnncac

SEQ ID NO: 919 - DNA, 15 bp, Artificial Sequence
  Dyad patterns over-represented in STAR elements
  misc_feature (4)..(12): the `n' at positions 4-12 may be any nucleic acid
cggnnnnnnnnnggc

SEQ ID NO: 920 - DNA, 16 bp, Artificial Sequence
  Dyad patterns over-represented in STAR elements
  misc_feature (4)..(13): the `n' at positions 4-13 may be any nucleic acid
cgcnnnnnnnnnngcg

SEQ ID NO: 921 - DNA, 12 bp, Artificial Sequence
  Dyad patterns over-represented in STAR elements
  misc_feature (4)..(9): the `n' at positions 4-9 may be any nucleic acid
cccnnnnnnctc

SEQ ID NO: 922 - DNA, 16 bp, Artificial Sequence
  Dyad patterns over-represented in STAR elements
  misc_feature (4)..(13): the `n' at positions 4-13 may be any nucleic acid
ccgnnnnnnnnnnagg

SEQ ID NO: 923 - DNA, 24 bp, Artificial Sequence
  Dyad patterns over-represented in STAR elements
  misc_feature (4)..(21): the `n' at positions 4-21 may be any nucleic acid
cccnnnnnnnnnnnnnnnnnncag

SEQ ID NO: 924 - DNA, 23 bp, Artificial Sequence
  Dyad patterns over-represented in STAR elements
  misc_feature (4)..(20): the `n' at positions 4-20 may be any nucleic acid
agcnnnnnnnnnnnnnnnnnccg

SEQ ID NO: 925 - DNA, 15 bp, Artificial Sequence
  Dyad patterns over-represented in STAR elements
  misc_feature (4)..(12): the `n' at positions 4-12 may be any nucleic acid
agcnnnnnnnnngcg

SEQ ID NO: 926 - DNA, 9 bp, Artificial Sequence
  Dyad patterns over-represented in STAR elements
  misc_feature (4)..(6): the `n' at positions 4-6 may be any nucleic acid
ccannnggc

SEQ ID NO: 927 - DNA, 17 bp, Artificial Sequence
  Dyad patterns over-represented in STAR elements
  misc_feature (4)..(14): the `n' at positions 4-14 may be any nucleic acid
cccnnnnnnnnnnnggc

SEQ ID NO: 928 - DNA, 11 bp, Artificial Sequence
  Dyad patterns over-represented in STAR elements
  misc_feature (4)..(8): the `n' at positions 4-8 may be any nucleic acid
acgnnnnngca

SEQ ID NO: 929 - DNA, 20 bp, Artificial Sequence
  Dyad patterns over-represented in STAR elements
  misc_feature (4)..(17): the `n' at positions 4-17 may be any nucleic acid
cccnnnnnnnnnnnnnncgg

SEQ ID NO: 930 - DNA, 11 bp, Artificial Sequence
  Dyad patterns over-represented in STAR elements
  misc_feature (4)..(8): the `n' at positions 4-8 may be any nucleic acid
cccnnnnncca

SEQ ID NO: 931 - DNA, 7 bp, Artificial Sequence
  Dyad patterns over-represented in STAR elements
  misc_feature (4)..(4): the `n' at position 4 may be any nucleic acid
ccgnagg

SEQ ID NO: 932 - DNA, 16 bp, Artificial Sequence
  Dyad patterns over-represented in STAR elements
  misc_feature (4)..(13): the `n' at positions 4-13 may be any nucleic acid
gggnnnnnnnnnngac

SEQ ID NO: 933 - DNA, 21 bp, Artificial Sequence
  Dyad patterns over-represented in STAR elements
  misc_feature (4)..(18): the `n' at positions 4-18 may be any nucleic acid
cgcnnnnnnnnnnnnnnncca

SEQ ID NO: 934 - DNA, 25 bp, Artificial Sequence
  Dyad patterns over-represented in STAR elements
  misc_feature (4)..(22): the `n' at positions 4-22 may be any nucleic acid
cctnnnnnnnnnnnnnnnnnnncgc

SEQ ID NO: 935 - DNA, 9 bp, Artificial Sequence
  Dyad patterns over-represented in STAR elements
  misc_feature (4)..(6): the `n' at positions 4-6 may be any nucleic acid
cgtnnncgc

SEQ ID NO: 936 - DNA, 20 bp, Artificial Sequence
  Dyad patterns over-represented in STAR elements
  misc_feature (4)..(17): the `n' at positions 4-17 may be any nucleic acid
agcnnnnnnnnnnnnnnccg

SEQ ID NO: 937 - DNA, 8 bp, Artificial Sequence
  Dyad patterns over-represented in STAR elements
  misc_feature (4)..(5): the `n' at positions 4-5 may be any nucleic acid
ggcnncga

SEQ ID NO: 938 - DNA, 14 bp, Artificial Sequence
  Dyad patterns over-represented in STAR elements
  misc_feature (4)..(11): the `n' at positions 4-11 may be any nucleic acid
cagnnnnnnnnccc

SEQ ID NO: 939 - DNA, 8 bp, Artificial Sequence
  Dyad patterns over-represented in STAR elements
  misc_feature (4)..(5): the `n' at positions 4-5 may be any nucleic acid
ccgnngac

SEQ ID NO: 940 - DNA, 25 bp, Artificial Sequence
  Dyad patterns over-represented in STAR elements
  misc_feature (4)..(22): the `n' at positions 4-22 may be any nucleic acid
agcnnnnnnnnnnnnnnnnnnnagg

SEQ ID NO: 941 - DNA, 10 bp, Artificial Sequence
  Dyad patterns over-represented in STAR elements
  misc_feature (4)..(7): the `n' at positions 4-7 may be any nucleic acid
cctnnnnggc

SEQ ID NO: 942 - DNA, 17 bp, Artificial Sequence
  Dyad patterns over-represented in STAR elements
  misc_feature (4)..(14): the `n' at positions 4-14 may be any nucleic acid
ccgnnnnnnnnnnnagc

SEQ ID NO: 943 - DNA, 10 bp, Artificial Sequence
  Dyad patterns over-represented in STAR elements
  misc_feature (4)..(7): the `n' at positions 4-7 may be any nucleic acid
cacnnnncgc

SEQ ID NO: 944 - DNA, 7 bp, Artificial Sequence
  Dyad patterns over-represented in STAR elements
  misc_feature (4)..(4): the `n' at position 4 may be any nucleic acid
ccgnccc

SEQ ID NO: 945 - DNA, 19 bp, Artificial Sequence
  Dyad patterns over-represented in STAR elements
  misc_feature (4)..(16): the `n' at positions 4-16 may be any nucleic acid
ctgnnnnnnnnnnnnnggc

SEQ ID NO: 946 - DNA, 22 bp, Artificial Sequence
  Dyad patterns over-represented in STAR elements
  misc_feature (4)..(19): the `n' at positions 4-19 may be any nucleic acid
cgcnnnnnnnnnnnnnnnnacc

SEQ ID NO: 947 - DNA, 24 bp, Artificial Sequence
  Dyad patterns over-represented in STAR elements
  misc_feature (4)..(21): the `n' at positions 4-21 may be any nucleic acid
cacnnnnnnnnnnnnnnnnnncag

SEQ ID NO: 948 - DNA, 14 bp, Artificial Sequence
  Dyad patterns over-represented in STAR elements
  misc_feature (4)..(11): the `n' at positions 4-11 may be any nucleic acid
ggcnnnnnnnngcc

SEQ ID NO: 949 - DNA, 21 bp, Artificial Sequence
  Dyad patterns over-represented in STAR elements
  misc_feature (4)..(18): the `n' at positions 4-18 may be any nucleic acid
gggnnnnnnnnnnnnnnngga

SEQ ID NO: 950 - DNA, 22 bp, Artificial Sequence
  Dyad patterns over-represented in STAR elements
  misc_feature (4)..(19): the `n' at positions 4-19 may be any nucleic acid
ccgnnnnnnnnnnnnnnnngcc

SEQ ID NO: 951 - DNA, 26 bp, Artificial Sequence
  Dyad patterns over-represented in STAR elements
  misc_feature (4)..(23): the `n' at positions 4-23 may be any nucleic acid
ccgnnnnnnnnnnnnnnnnnnnnacc

SEQ ID NO: 952 - DNA, 13 bp, Artificial Sequence
  Dyad patterns over-represented in STAR elements
  misc_feature (4)..(10): the `n' at positions 4-10 may be any nucleic acid
cgannnnnnnccc

SEQ ID NO: 953 - DNA, 12 bp, Artificial Sequence
  Dyad patterns over-represented in STAR elements
  misc_feature (4)..(9): the `n' at positions 4-9 may be any nucleic acid
ccgnnnnnnctc

SEQ ID NO: 954 - DNA, 16 bp, Artificial Sequence
  Dyad patterns over-represented in STAR elements
  misc_feature (4)..(13): the `n' at positions 4-13 may be any nucleic acid
cggnnnnnnnnnnctc

SEQ ID NO: 955 - DNA, 22 bp, Artificial Sequence
  Dyad patterns over-represented in STAR elements
  misc_feature (4)..(19): the `n' at positions 4-19 may be any nucleic acid
cagnnnnnnnnnnnnnnnncgc

SEQ ID NO: 956 - DNA, 9 bp, Artificial Sequence
  Dyad patterns over-represented in STAR elements
  misc_feature (4)..(6): the `n' at positions 4-6 may be any nucleic acid
ccannnagg

SEQ ID NO: 957 - DNA, 24 bp, Artificial Sequence
  Dyad patterns over-represented in STAR elements
  misc_feature (4)..(21): the `n' at positions 4-21 may be any nucleic acid
gccnnnnnnnnnnnnnnnnnngcc

SEQ ID NO: 958 - DNA, 24 bp, Artificial Sequence
  Dyad patterns over-represented in STAR elements
  misc_feature (4)..(21): the `n' at positions 4-21 may be any nucleic acid
cgcnnnnnnnnnnnnnnnnnngga

SEQ ID NO: 959 - DNA, 26 bp, Artificial Sequence
  Dyad patterns over-represented in STAR elements
  misc_feature (4)..(23): the `n' at positions 4-23 may be any nucleic acid
ccgnnnnnnnnnnnnnnnnnnnnggc

SEQ ID NO: 960 - DNA, 16 bp, Artificial Sequence
  Dyad patterns over-represented in STAR elements
  misc_feature (4)..(13): the `n' at positions 4-13 may be any nucleic acid
acannnnnnnnnngcg

SEQ ID NO: 961 - DNA, 11 bp, Artificial Sequence
  Dyad patterns over-represented in STAR elements
  misc_feature (4)..(8): the `n' at positions 4-8 may be any nucleic acid
cggnnnnnccc

SEQ ID NO: 962 - DNA, 13 bp, Artificial Sequence
  Dyad patterns over-represented in STAR elements
  misc_feature (4)..(10): the `n' at positions 4-10 may be any nucleic acid
cccnnnnnnntcc

SEQ ID NO: 963 - DNA, 16 bp, Artificial Sequence
  Dyad patterns over-represented in STAR elements
  misc_feature (4)..(13): the `n' at positions 4-13 may be any nucleic acid
acgnnnnnnnnnncgc

SEQ ID NO: 964 - DNA, 9 bp, Artificial Sequence
  Dyad patterns over-represented in STAR elements
  misc_feature (4)..(6): the `n' at positions 4-6 may be any nucleic acid
cccnnntcc

SEQ ID NO: 965 - DNA, 14 bp, Artificial Sequence
  Dyad patterns over-represented in STAR elements
  misc_feature (4)..(11): the `n' at positions 4-11 may be any nucleic acid
ccgnnnnnnnncgg

SEQ ID NO: 966 - DNA, 21 bp, Artificial Sequence
  Dyad patterns over-represented in STAR elements
  misc_feature (4)..(18): the `n' at positions 4-18 may be any nucleic acid
ccannnnnnnnnnnnnnncgg

SEQ ID NO: 967 - DNA, 12 bp, Artificial Sequence
  Dyad patterns over-represented in STAR elements
  misc_feature (4)..(9): the `n' at positions 4-9 may be any nucleic acid
ccgnnnnnnccg

SEQ ID NO: 968 - DNA, 9 bp, Artificial Sequence
  Dyad patterns over-represented in STAR elements
  misc_feature (4)..(6): the `n' at positions 4-6 may be any nucleic acid
cagnnngcg

SEQ ID NO: 969 - DNA, 7 bp, Artificial Sequence
  Dyad patterns over-represented in STAR elements
  misc_feature (4)..(4): the `n' at position 4 may be any nucleic acid
gagnccc

SEQ ID NO: 970 - DNA, 24 bp, Artificial Sequence
  Dyad patterns over-represented in STAR elements
  misc_feature (4)..(21): the `n' at positions 4-21 may be any nucleic acid
ccgnnnnnnnnnnnnnnnnnntgc

SEQ ID NO: 971 - DNA, 13 bp, Artificial Sequence
  Dyad patterns over-represented in STAR elements
  misc_feature (4)..(10): the `n' at positions 4-10 may be any nucleic acid
cccnnnnnnncca

SEQ ID NO: 972 - DNA, 9 bp, Artificial Sequence
  Dyad patterns over-represented in STAR elements
  misc_feature (4)..(6): the `n' at positions 4-6 may be any nucleic acid
cggnnncca

SEQ ID NO: 973 - DNA, 7 bp, Artificial Sequence
  Dyad patterns over-represented in STAR elements
  misc_feature (4)..(4): the `n' at position 4 may be any nucleic acid
acgnccc

SEQ ID NO: 974 - DNA, 19 bp, Artificial Sequence
  Dyad patterns over-represented in STAR elements
  misc_feature (4)..(16): the `n' at positions 4-16 may be any nucleic acid
cggnnnnnnnnnnnnntga

SEQ ID NO: 975 - DNA, 12 bp, Artificial Sequence
  Dyad patterns over-represented in STAR elements
  misc_feature (4)..(9): the `n' at positions 4-9 may be any nucleic acid
ctcnnnnnnggc

SEQ ID NO: 976 - DNA, 8 bp, Artificial Sequence
  Dyad patterns over-represented in STAR elements
  misc_feature (4)..(5): the `n' at positions 4-5 may be any nucleic acid
gcgnngac

SEQ ID NO: 977 - DNA, 17 bp, Artificial Sequence
  Dyad patterns over-represented in STAR elements
  misc_feature (4)..(14): the `n' at positions 4-14 may be any nucleic acid
gggnnnnnnnnnnnacc

SEQ ID NO: 978 - DNA, 10 bp, Artificial Sequence
  Dyad patterns over-represented in STAR elements
  misc_feature (4)..(7): the `n' at positions 4-7 may be any nucleic acid
cgcnnnngga

SEQ ID NO: 979 - DNA, 17 bp, Artificial Sequence
  Dyad patterns over-represented in STAR elements
  misc_feature (4)..(14): the `n' at positions 4-14 may be any nucleic acid
cccnnnnnnnnnnnccg

SEQ ID NO: 980 - DNA, 25 bp, Artificial Sequence
  Dyad patterns over-represented in STAR elements
  misc_feature (4)..(22): the `n' at positions 4-22 may be any nucleic acid
ccgnnnnnnnnnnnnnnnnnnngca

SEQ ID NO: 981 - DNA, 6 bp, Artificial Sequence
  Dyad patterns over-represented in STAR elements
gcggca

SEQ ID NO: 982 - DNA, 13 bp, Artificial Sequence
  Dyad patterns over-represented in STAR elements
  misc_feature (4)..(10): the `n' at positions 4-10 may be any nucleic acid
agannnnnnnccc

SEQ ID NO: 983 - DNA, 8 bp, Artificial Sequence
  Dyad patterns over-represented in STAR elements
  misc_feature (4)..(5): the `n' at positions 4-5 may be any nucleic acid
cggnncca

SEQ ID NO: 984 - DNA, 12 bp, Artificial Sequence
  Dyad patterns over-represented in STAR elements
  misc_feature (4)..(9): the `n' at positions 4-9 may be any nucleic acid
cccnnnnnnccc

SEQ ID NO: 985 - DNA, 10 bp, Artificial Sequence
  Dyad patterns over-represented in STAR elements
  misc_feature (4)..(7): the `n' at positions 4-7 may be any nucleic acid
accnnnngcg

SEQ ID NO: 986 - DNA, 21 bp, Artificial Sequence
  Dyad patterns over-represented in STAR elements
  misc_feature (4)..(18): the `n' at positions 4-18 may be any nucleic acid
cctnnnnnnnnnnnnnnncgc

SEQ ID NO: 987 - DNA, 15 bp, Artificial Sequence
  Dyad patterns over-represented in STAR elements
  misc_feature (4)..(12): the `n' at positions 4-12 may be any nucleic acid
agcnnnnnnnnngtc

SEQ ID NO: 988 - DNA, 24 bp, Artificial Sequence
  Dyad patterns over-represented in STAR elements
  misc_feature (4)..(21): the `n' at positions 4-21 may be any nucleic acid
cccnnnnnnnnnnnnnnnnnnctc

SEQ ID NO: 989 - DNA, 24 bp, Artificial Sequence
  Dyad patterns over-represented in STAR elements
  misc_feature (4)..(21): the `n' at positions 4-21 may be any nucleic acid
cgcnnnnnnnnnnnnnnnnnncga

SEQ ID NO: 990 - DNA, 21 bp, Artificial Sequence
  Dyad patterns over-represented in STAR elements
  misc_feature (4)..(18): the `n' at positions 4-18 may be any nucleic acid
cccnnnnnnnnnnnnnnngcc

SEQ ID NO: 991 - DNA, 17 bp, Artificial Sequence
  Dyad patterns over-represented in STAR elements
  misc_feature (4)..(14): the `n' at positions 4-14 may be any nucleic acid
accnnnnnnnnnnnggc

SEQ ID NO: 992 - DNA, 21 bp, Artificial Sequence
  Dyad patterns over-represented in STAR elements
  misc_feature (4)..(18): the `n' at positions 4-18 may be any nucleic acid
aggnnnnnnnnnnnnnnncgc

SEQ ID NO: 993 - DNA, 6 bp, Artificial Sequence
  Dyad patterns over-represented in STAR elements
gcgcca

SEQ ID NO: 994 - DNA, 15 bp, Artificial Sequence
  Dyad patterns over-represented in STAR elements
  misc_feature (4)..(12): the `n' at positions 4-12 may be any nucleic acid
gcgnnnnnnnnnagc

SEQ ID NO: 995 - DNA, 24 bp, Artificial Sequence
  Dyad patterns over-represented in STAR elements
  misc_feature (4)..(21): the `n' at positions 4-21 may be any nucleic acid
gggnnnnnnnnnnnnnnnnnngca

SEQ ID NO: 996 - DNA, 23 bp, Artificial Sequence
  Dyad patterns over-represented in STAR elements
  misc_feature (4)..(20): the `n' at positions 4-20 may be any nucleic acid
cccnnnnnnnnnnnnnnnnncag

SEQ ID NO: 997 - DNA, 14 bp, Artificial Sequence
  Dyad patterns over-represented in STAR elements
  misc_feature (4)..(11): the `n' at positions 4-11 may be any nucleic acid
ccannnnnnnncgg

SEQ ID NO: 998 - DNA, 16 bp, Artificial Sequence
  Dyad patterns over-represented in STAR elements
  misc_feature (4)..(13): the `n' at positions 4-13 may be any nucleic acid
ccgnnnnnnnnnnggc

SEQ ID NO: 999 - DNA, 6 bp, Artificial Sequence
  Dyad patterns over-represented in STAR elements
gcagcc

SEQ ID NO: 1000 - DNA, 8 bp, Artificial Sequence
  Dyad patterns over-represented in STAR elements
  misc_feature (4)..(5): the `n' at positions 4-5 may be any nucleic acid
cagnncgc

SEQ ID NO: 1001 - DNA, 14 bp, Artificial Sequence
  Dyad patterns over-represented in STAR elements
  misc_feature (4)..(11): the `n' at positions 4-11 may be any nucleic acid
cgcnnnnnnnnggc

SEQ ID NO: 1002 - DNA, 23 bp, Artificial Sequence
  Dyad patterns over-represented in STAR elements
  misc_feature (4)..(20): the `n' at positions 4-20 may be any nucleic acid
ctgnnnnnnnnnnnnnnnnnggc

SEQ ID NO: 1003 - DNA, 20 bp, Artificial Sequence
  Dyad patterns over-represented in STAR elements
  misc_feature (4)..(17): the `n' at positions 4-17 may be any nucleic acid
gggnnnnnnnnnnnnnnacc

SEQ ID NO: 1004 - DNA, 7 bp, Artificial Sequence
  Dyad patterns over-represented in STAR elements
  misc_feature (4)..(4): the `n' at position 4 may be any nucleic acid
ccgntgc

SEQ ID NO: 1005 - DNA, 14 bp, Artificial Sequence
  Dyad patterns over-represented in STAR elements
  misc_feature (4)..(11): the `n' at positions 4-11 may be any nucleic acid
cagnnnnnnnncgc

SEQ ID NO: 1006 - DNA, 17 bp, Artificial Sequence
  Dyad patterns over-represented in STAR elements
  misc_feature (4)..(14): the `n' at positions 4-14 may be any nucleic acid
aagnnnnnnnnnnncgc

SEQ ID NO: 1007 - DNA, 12 bp, Artificial Sequence
  Dyad patterns over-represented in STAR elements
  misc_feature (4)..(9): the `n' at positions 4-9 may be any nucleic acid
ccgnnnnnntcc

SEQ ID NO: 1008 - DNA, 24 bp, Artificial Sequence
  Dyad patterns over-represented in STAR elements
  misc_feature (4)..(21): the `n' at positions 4-21 may be any nucleic acid
ccannnnnnnnnnnnnnnnnnccc

SEQ ID NO: 1009 - DNA, 6 bp, Artificial Sequence
  Dyad patterns over-represented in STAR elements
ccaccc

SEQ ID NO: 1010 - DNA, 12 bp, Artificial Sequence
  Dyad patterns over-represented in STAR elements
  misc_feature (4)..(9): the `n' at positions 4-9 may be any nucleic acid
gagnnnnnnccc

SEQ ID NO: 1011 - DNA, 26 bp, Artificial Sequence
  Dyad patterns over-represented in STAR elements
  misc_feature (4)..(23): the `n' at positions 4-23 may be any nucleic acid
agcnnnnnnnnnnnnnnnnnnnnggc

SEQ ID NO: 1012 - DNA, 6 bp, Artificial Sequence
  Dyad patterns over-represented in STAR elements
cagcgc

SEQ ID NO: 1013 - DNA, 18 bp, Artificial Sequence
  Dyad patterns over-represented in STAR elements
  misc_feature (4)..(15): the `n' at positions 4-15 may be any nucleic acid
ccgnnnnnnnnnnnnctc

SEQ ID NO: 1014 - DNA, 21 bp, Artificial Sequence
  Dyad patterns over-represented in STAR elements
  misc_feature (4)..(18): the `n' at positions 4-18 may be any nucleic acid
cgcnnnnnnnnnnnnnnnacg

SEQ ID NO: 1015 - DNA, 23 bp, Artificial Sequence
  Dyad patterns over-represented in STAR elements
  misc_feature (4)..(20): the `n' at positions 4-20 may be any nucleic acid
ggcnnnnnnnnnnnnnnnnncga

SEQ ID NO: 1016 - DNA, 22 bp, Artificial Sequence
  Dyad patterns over-represented in STAR elements
  misc_feature (4)..(19): the `n' at positions 4-19 may be any nucleic acid
ccgnnnnnnnnnnnnnnnnaag

SEQ ID NO: 1017 - DNA, 20 bp, Artificial Sequence
  Dyad patterns over-represented in STAR elements
  misc_feature (4)..(17): the `n' at positions 4-17 may be any nucleic acid
cgcnnnnnnnnnnnnnntcc

SEQ ID NO: 1018 - DNA, 13 bp, Artificial Sequence
  Dyad patterns over-represented in STAR elements
  misc_feature (4)..(10): the `n' at positions 4-10 may be any nucleic acid
aggnnnnnnncgc

SEQ ID NO: 1019 - DNA, 13 bp, Artificial Sequence
  Dyad patterns over-represented in STAR elements
  misc_feature (4)..(10): the `n' at positions 4-10 may be any nucleic acid
cggnnnnnnnccc

SEQ ID NO: 1020 - DNA, 10 bp, Artificial Sequence
  Dyad patterns over-represented in STAR elements
  misc_feature (4)..(7): the `n' at positions 4-7 may be any nucleic acid
cgcnnnngcc

SEQ ID NO: 1021 - DNA, 12 bp, Artificial Sequence
  Dyad patterns over-represented in STAR elements
  misc_feature (4)..(9): the `n' at positions 4-9 may be any nucleic acid
cgannnnnnccc

SEQ ID NO: 1022 - DNA, 25 bp, Artificial Sequence
  Dyad patterns over-represented in STAR elements
  misc_feature (4)..(22): the `n' at positions 4-22 may be any nucleic acid
cccnnnnnnnnnnnnnnnnnnngga

SEQ ID NO: 1023 - DNA, 22 bp, Artificial Sequence
  Dyad patterns over-represented in STAR elements
  misc_feature (4)..(19): the `n' at positions 4-19 may be any nucleic acid
cccnnnnnnnnnnnnnnnngcg

SEQ ID NO: 1024 - DNA, 13 bp, Artificial Sequence
  Dyad patterns over-represented in STAR elements
  misc_feature (4)..(10): the `n' at positions 4-10 may be any nucleic acid
ccannnnnnncgc

SEQ ID NO: 1025 - DNA, 12 bp, Artificial Sequence
  Dyad patterns over-represented in STAR elements
  misc_feature (4)..(9): the `n' at positions 4-9 may be any nucleic acid
cccnnnnnngcc

SEQ ID NO: 1026 - DNA, 20 bp, Artificial Sequence
  Dyad patterns over-represented in STAR elements
  misc_feature (4)..(17): the `n' at positions 4-17 may be any nucleic acid
gccnnnnnnnnnnnnnntcc

SEQ ID NO: 1027 - DNA, 20 bp, Artificial Sequence
  Dyad patterns over-represented in STAR elements
  misc_feature (4)..(17): the `n' at positions 4-17 may be any nucleic acid
aggnnnnnnnnnnnnnngcc

SEQ ID NO: 1028 - DNA, 17 bp, Artificial Sequence
  Dyad patterns over-represented in STAR elements
  misc_feature (4)..(14): the `n' at positions 4-14 may be any nucleic acid
cgcnnnnnnnnnnngcc

SEQ ID NO: 1029 - DNA, 6 bp, Artificial Sequence
  Dyad patterns over-represented in STAR elements
tccgca

SEQ ID NO: 1030 - DNA, 14 bp, Artificial Sequence
  Dyad patterns over-represented in STAR elements
  misc_feature (4)..(11): the `n' at positions 4-11 may be any nucleic acid
gcgnnnnnnnnccc

SEQ ID NO: 1031 - DNA, 17 bp, Artificial Sequence
  Dyad patterns over-represented in STAR elements
  misc_feature (4)..(14): the `n' at positions 4-14 may be any nucleic acid
ccannnnnnnnnnngcg

SEQ ID NO: 1032 - DNA, 10 bp, Artificial Sequence
  Dyad patterns over-represented in STAR elements
  misc_feature (4)..(7): the `n' at positions 4-7 may be any nucleic acid
cacnnnnggg

SEQ ID NO: 1033 - DNA, 13 bp, Artificial Sequence
  Dyad patterns over-represented in STAR elements
  misc_feature (4)..(10): the `n' at positions 4-10 may be any nucleic acid
cggnnnnnnntcc

SEQ ID NO: 1034 - DNA, 11 bp, Artificial Sequence
  Dyad patterns over-represented in STAR elements
  misc_feature (4)..(8): the `n' at positions 4-8 may be any nucleic acid
gcgnnnnngcc

SEQ ID NO: 1035 - DNA, 18 bp, Artificial Sequence
  Dyad patterns over-represented in STAR elements
  misc_feature (4)..(15): the `n' at positions 4-15 may be any nucleic acid
acgnnnnnnnnnnnncag

SEQ ID NO: 1036 - DNA, 25 bp, Artificial Sequence
  Dyad patterns over-represented in STAR elements
  misc_feature (4)..(22): the `n' at positions 4-22 may be any nucleic acid
ccgnnnnnnnnnnnnnnnnnnncgc

SEQ ID NO: 1037 - DNA, 14 bp, Artificial Sequence
  Dyad patterns over-represented in STAR elements
  misc_feature (4)..(11): the `n' at positions 4-11 may be any nucleic acid
cggnnnnnnnntgc

SEQ ID NO: 1038 - DNA, 7 bp, Artificial Sequence
  Dyad patterns over-represented in STAR elements
  misc_feature (4)..(4): the `n' at position 4 may be any nucleic acid
cccngag

SEQ ID NO: 1039 - DNA, 25 bp, Artificial Sequence
  Dyad patterns over-represented in STAR elements
  misc_feature (4)..(22): the `n' at positions 4-22 may be any nucleic acid
gcgnnnnnnnnnnnnnnnnnnntga

SEQ ID NO: 1040 - DNA, 21 bp, Artificial Sequence
  Dyad patterns over-represented in STAR elements
  misc_feature (4)..(18): the `n' at positions 4-18 may be any nucleic acid
ggcnnnnnnnnnnnnnnngcc

SEQ ID NO: 1041 - DNA, 13 bp, Artificial Sequence
  Dyad patterns over-represented in STAR elements
  misc_feature (4)..(10): the `n' at positions 4-10 may be any nucleic acid
ccgnnnnnnnccc

SEQ ID NO: 1042 - DNA, 25 bp, Artificial Sequence
  Dyad patterns over-represented in STAR elements
  misc_feature (4)..(22): the `n' at positions 4-22 may be any nucleic acid
acannnnnnnnnnnnnnnnnnnccc

SEQ ID NO: 1043 - DNA, 22 bp, Artificial Sequence
  Dyad patterns over-represented in STAR elements
  misc_feature (4)..(19): the `n' at positions 4-19 may be any nucleic acid
accnnnnnnnnnnnnnnnnggg

SEQ ID NO: 1044 - DNA, 7 bp, Artificial Sequence
  Dyad patterns over-represented in STAR elements
  misc_feature (4)..(4): the `n' at position 4 may be any nucleic acid
aganggc

SEQ ID NO: 1045 - DNA, 23 bp, Artificial Sequence
  Dyad patterns over-represented in STAR elements
  misc_feature (4)..(20): the `n' at positions 4-20 may be any nucleic acid
gggnnnnnnnnnnnnnnnnntga

SEQ ID NO: 1046 - DNA, 11 bp, Artificial Sequence
  Dyad patterns over-represented in STAR elements
  misc_feature (4)..(8): the `n' at positions 4-8 may be any nucleic acid
cagnnnnnggg

SEQ ID NO: 1047 - DNA, 19 bp, Artificial Sequence
  Dyad patterns over-represented in STAR elements
  misc_feature (4)..(16): the `n' at positions 4-16 may be any nucleic acid
gccnnnnnnnnnnnnncgc

SEQ ID NO: 1048 - DNA, 13 bp, Artificial Sequence
  Dyad patterns over-represented in STAR elements
  misc_feature (4)..(10): the `n' at positions 4-10 may be any nucleic acid
gcgnnnnnnngga

SEQ ID NO: 1049 - DNA, 20 bp, Artificial Sequence
  Dyad patterns over-represented in STAR elements
  misc_feature (4)..(17): the `n' at positions 4-17 may be any nucleic acid
cagnnnnnnnnnnnnnncca

SEQ ID NO: 1050 - DNA, 10 bp, Artificial Sequence
  Dyad patterns over-represented in STAR elements
  misc_feature (4)..(7): the `n' at positions 4-7 may be any nucleic acid
ccgnnnngtc

SEQ ID NO: 1051 - DNA, 19 bp, Artificial Sequence
  Dyad patterns over-represented in STAR elements
  misc_feature (4)..(16): the `n' at positions 4-16 may be any nucleic acid
cccnnnnnnnnnnnnncgc

SEQ ID NO: 1052 - DNA, 20 bp, Artificial Sequence
  Dyad patterns over-represented in STAR elements
  misc_feature (4)..(17): the `n' at positions 4-17 may be any nucleic acid
gcgnnnnnnnnnnnnnnacc

SEQ ID NO: 1053 - DNA, 26 bp, Artificial Sequence
  Dyad patterns over-represented in STAR elements
  misc_feature (4)..(23): the `n' at positions 4-23 may be any nucleic acid
cagnnnnnnnnnnnnnnnnnnnnggg

SEQ ID NO: 1054 - DNA, 10 bp, Artificial Sequence
  Dyad patterns over-represented in STAR elements
  misc_feature (4)..(7): the `n' at positions 4-7 may be any nucleic acid
ccgnnnnccc

SEQ ID NO: 1055 - DNA, 11 bp, Artificial Sequence
  Dyad patterns over-represented in STAR elements
  misc_feature (4)..(8): the `n' at positions 4-8 may be any nucleic acid
cgcnnnnnggc

SEQ ID NO: 1056 - DNA, 12 bp, Artificial Sequence
  Dyad patterns over-represented in STAR elements
  misc_feature (4)..(9): the `n' at positions 4-9 may be any nucleic acid
cctnnnnnnggc

SEQ ID NO: 1057 - DNA, 9 bp, Artificial Sequence
  Dyad patterns over-represented in STAR elements
  misc_feature (4)..(6): the `n' at positions 4-6 may be any nucleic acid
aggnnnggc

SEQ ID NO: 1058 - DNA, 17 bp, Artificial Sequence
  Dyad patterns over-represented in STAR elements
  misc_feature (4)..(14): the `n' at positions 4-14 may be any nucleic acid
cggnnnnnnnnnnncgc

SEQ ID NO: 1059 - DNA, 24 bp, Artificial Sequence
  Dyad patterns over-represented in STAR elements
  misc_feature (4)..(21): the `n' at positions 4-21 may be any nucleic acid
ctgnnnnnnnnnnnnnnnnnngga

SEQ ID NO: 1060 - DNA, 23 bp, Artificial Sequence
  Dyad patterns over-represented in STAR elements
  misc_feature (4)..(20): the `n' at positions 4-20 may be any nucleic acid
cacnnnnnnnnnnnnnnnnncca

SEQ ID NO: 1061 - DNA, 9 bp, Artificial Sequence
  Dyad patterns over-represented in STAR elements
  misc_feature (4)..(6): the `n' at positions 4-6 may be any nucleic acid
cggnnngag

SEQ ID NO: 1062 - DNA, 15 bp, Artificial Sequence
  Dyad patterns over-represented in STAR elements
  misc_feature (4)..(12): the `n' at positions 4-12 may be any nucleic acid
cccnnnnnnnnncca

SEQ ID NO: 1063 - DNA, 7 bp, Artificial Sequence
  Dyad patterns over-represented in STAR elements
  misc_feature (4)..(4): the `n' at position 4 may be any nucleic acid
cccnacg

SEQ ID NO: 1064 - DNA, 7 bp, Artificial Sequence
  Dyad patterns over-represented in STAR elements
  misc_feature (4)..(4): the `n' at position 4 may be any nucleic acid
cagngcc

SEQ ID NO: 1065 - DNA, 12 bp, Artificial Sequence
  Dyad patterns over-represented in STAR elements
  misc_feature (4)..(9): the `n' at positions 4-9 may be any nucleic acid
aggnnnnnnccg

SEQ ID NO: 1066 - DNA, 15 bp, Artificial Sequence
  Dyad patterns over-represented in STAR elements
  misc_feature (4)..(12): the `n' at positions 4-12 may be any nucleic acid
agcnnnnnnnnnggg

SEQ ID NO: 1067 - DNA, 13 bp, Artificial Sequence
  Dyad patterns over-represented in STAR elements
  misc_feature (4)..(10): the `n' at positions 4-10 may be any nucleic acid
cccnnnnnnnggc

SEQ ID NO: 1068 - DNA, 19 bp, Artificial Sequence
  Dyad patterns over-represented in STAR elements
  misc_feature (4)..(16): the `n' at positions 4-16 may be any nucleic acid
cctnnnnnnnnnnnnnccc

SEQ ID NO: 1069 - DNA, 25 bp, Artificial Sequence
  Dyad patterns over-represented in STAR elements
  misc_feature (4)..(22): the `n' at positions 4-22 may be any nucleic acid
ccgnnnnnnnnnnnnnnnnnnnttc

SEQ ID NO: 1070 - DNA, 13 bp, Artificial Sequence
  Dyad patterns over-represented in STAR elements
  misc_feature (4)..(10): the `n' at positions 4-10 may be any nucleic acid
cccnnnnnnnccg

SEQ ID NO: 1071 - DNA, 12 bp, Artificial Sequence
  Dyad patterns over-represented in STAR elements
  misc_feature (4)..(9): the `n' at positions 4-9 may be any nucleic acid
cgannnnnnggc

SEQ ID NO: 1072 - DNA, 10 bp, Artificial Sequence
  Dyad patterns over-represented in STAR elements
  misc_feature (4)..(7): the `n' at positions 4-7 may be any nucleic acid
cggnnnnctc

SEQ ID NO: 1073 - DNA, 6 bp, Artificial Sequence
  Dyad patterns over-represented in STAR elements
cggcgc

SEQ ID NO: 1074 - DNA, 19 bp, Artificial Sequence
  Dyad patterns over-represented in STAR elements
  misc_feature (4)..(16): the `n' at positions 4-16 may be any nucleic acid
cctnnnnnnnnnnnnnacg

SEQ ID NO: 1075 - DNA, 12 bp, Artificial Sequence
  Dyad patterns over-represented in STAR elements
  misc_feature (4)..(9): the `n' at positions 4-9 may be any nucleic acid
gggnnnnnncac

SEQ ID NO: 1076 - DNA, 22 bp, Artificial Sequence
  Dyad patterns over-represented in STAR elements
  misc_feature (4)..(19): the `n' at positions 4-19 may be any nucleic acid
cccnnnnnnnnnnnnnnnncgc

SEQ ID NO: 1077 - DNA, 16 bp, Artificial Sequence
  Dyad patterns over-represented in STAR elements
  misc_feature (4)..(13): the `n' at positions 4-13 may be any nucleic acid
cccnnnnnnnnnnctc

SEQ ID NO: 1078 - DNA, 6 bp, Artificial Sequence
  Dyad patterns over-represented in STAR elements
ccccag

SEQ ID NO: 1079 - DNA, 11 bp, Artificial Sequence
  Dyad patterns over-represented in STAR elements
  misc_feature (4)..(8): the `n' at positions 4-8 may be any nucleic acid
gccnnnnnccc

What is claimed is:

1. A nucleotide construct comprising an expression cassette comprising a promoter operably linked to a nucleic acid sequence of interest, wherein the nucleotide construct comprises the sequence of SEQ ID NO: 29 both upstream and downstream of the expression cassette.

2. The nucleotide construct of claim 1, wherein the nucleic acid sequence of interest is a transgene open reading frame.

3. The nucleotide construct of claim 1, wherein the promoter is an exogenous promoter.

4. An isolated host cell comprising a nucleotide construct, wherein the nucleotide construct comprises an expression cassette comprising a promoter operably linked to a nucleic acid sequence of interest and wherein the nucleotide construct further comprises the sequence of SEQ ID NO: 29 both upstream and downstream of the expression cassette.

5. The host cell of claim 4, wherein the host cell is a Chinese hamster ovary (CHO) cell.

6. The host cell of claim 4, wherein the nucleic acid sequence of interest is a transgene open reading frame.

7. The host cell of claim 4, wherein the promoter is an exogenous promoter.

8. The host cell of claim 4, wherein the promoter is a constitutive promoter.

9. The host cell of claim 4, wherein the promoter is a viral promoter.

10. The host cell of claim 4, wherein the promoter is an inducible promoter.

11. The host cell of claim 4, wherein the promoter is a CMV promoter.

12. The host cell of claim 4, wherein the promoter is an SV40 promoter.

13. The host cell of claim 4, wherein the nucleotide construct is integrated into the host cell's genome.

14. The host cell of claim 4, wherein both copies of SEQ ID NO: 29 are directed with their 3' ends to the expression cassette.

15. A DNA construct comprising in the following order:
(i) SEQ ID NO: 29;
(ii) an expression cassette comprising a promoter operably linked to a nucleic acid sequence of interest; and
(iii) SEQ ID NO: 29, in opposite orientation as (i).

16. The DNA construct of claim 15, wherein the 3' end of SEQ ID NO: 29 both in (i) and (iii) is directed to the expression cassette.

17. An isolated cell comprising the DNA construct of claim 15.

18. The cell of claim 17, wherein the DNA construct is integrated into the cell's genome.

19. The cell of claim 17, wherein the cell is a CHO cell.

20. The cell of claim 17, comprising multiple copies of the DNA construct.

21. A method of producing a gene product in an isolated cell, the method comprising:
providing a nucleotide construct comprising:
an expression cassette comprising a gene of interest operably linked to a promoter,
a copy of the sequence of SEQ ID NO: 29 downstream of the expression cassette; and
a second copy of the sequence of SEQ ID NO: 29 upstream of the expression cassette;
providing the nucleotide construct to an isolated cell; and
transcribing the expression cassette in the cell so as to produce a gene product in the cell.

22. A method for producing a gene product in an isolated cell, comprising:
(a) providing an isolated cell comprising a DNA construct comprising in the following order:
(i) SEQ ID NO: 29;
(ii) an expression cassette comprising a promoter operably linked to a nucleic acid sequence encoding the gene product; and
(iii) SEQ ID NO: 29, in opposite orientation as (i),
(b) expressing the expression cassette in the cell.

23. A method for expressing a nucleic acid sequence of interest in a cell, comprising providing an isolated cell with the nucleotide construct of claim 1 and expressing the nucleic acid sequence of interest in said cell.

24. A method for producing a gene product that is encoded by a transgene open reading frame, comprising culturing the host cell of claim 6 and expressing the transgene open reading frame in said host cell.

25. The method of claim 24, further comprising isolating the gene product.

* * * * *

UNITED STATES PATENT AND TRADEMARK OFFICE
CERTIFICATE OF CORRECTION

PATENT NO. : 7,192,741 B2
APPLICATION NO. : 10/190312
DATED : March 20, 2007
INVENTOR(S) : Arie Pieter Otte and Arthur Leo Kruckeberg It is certified that error appears in the above-identified patent and that said Letters Patent is hereby corrected as shown below:

On the title page:
Item (75) titled Inventors:  change "Arie Peter Otte," to --Arie Pieter Otte,--

Item (56) References Cited:
OTHER PUBLICATIONS, Page 2

| | | |
|---|---|---|
| COLUMN 1, | LINE 42, | change "Unrealateed" to --Unrelated-- |
| COLUMN 2, | LINE 62, | change "in plotted." to --is plotted.-- |
| COLUMN 5, | LINE 25, | change "these region," to -- these regions,-- |
| COLUMN 5, | LINE 45, | change "phosphoimager." to --phospho imager.-- |
| COLUMN 6, | LINE 23, | change "in case expression" to --in the case where expression-- |
| COLUMN 6, | LINE 57, | after "expressing" and before "more" delete "a" |
| COLUMN 13, | LINE 45, | after "by" and before "method" insert --the-- |
| COLUMN 13, | LINE 45, | after "two" and before "method" insert --the-- |
| COLUMN 14, | LINE 41, | change "vertebrate of a plant." to --vertebrate or a plant.-- |
| COLUMN 15, | LINE 38, | change "quality. For" to --quality, for-- |
| COLUMN 15, | LINE 39, | after "in" and before "case" insert --the-- |
| COLUMN 17, | LINE 44, | after "or" and before "only" insert --not-- |
| COLUMN 17, | LINE 52, | after "of" and before "sequence" insert --a-- |
| COLUMN 18, | LINE 54, | after "is" and before "feature" insert --a-- |
| COLUMN 19, | LINE 26, | change "vertebrate." to --vertebrates.-- |
| COLUMN 19, | LINE 66, | change "sequence" to --sequences-- |
| COLUMN 21, | LINE 31, | after "under" and before "control" insert --the-- |
| COLUMN 22, | LINE 43, | after "contain" and before "DNA" insert --a-- |
| COLUMN 22, | LINE 44, | after "matches" and before "sequence" insert --a-- |
| COLUMN 23, | LINE 34, | change ""Invivogen porf-codaupp" to --InvivoGen porf-codA::upp-- |

UNITED STATES PATENT AND TRADEMARK OFFICE
CERTIFICATE OF CORRECTION

PATENT NO. : 7,192,741 B2
APPLICATION NO. : 10/190312
DATED : March 20, 2007
INVENTOR(S) : Arie Pieter Otte and Arthur Leo Kruckeberg It is certified that error appears in the above-identified patent and that said Letters Patent is hereby corrected as shown below:

| | | |
|---|---|---|
| COLUMN 29, | LINE 9, | change "DNAse I" to --DNase I-- |
| COLUMN 30, | LINES 14-15, | change "function" to --functions-- |
| COLUMN 33, | LINE 45, | change "CO2" to --$CO_2$-- |
| COLUMN 39, | LINE 4, | change "phosphoimager" to --phospho imager-- |
| COLUMN 40, | LINE 65, | after "with" and before "STARless" insert --a-- |
| COLUMN 42, | LINE 34, | change "SfuI-Sal I" to --SfuI-Sal--I |
| COLUMN 42, | LINE 37, | change "phosphoimager" to --phospho imager-- |
| COLUMN 42, | LINE 39, | change "phosphoimager." to --phospho imager.-- |
| COLUMN 43, | LINE 13, | change "the" to --said-- |
| COLUMN 46, | LINE 60, | change "of length 6" to --of a length of 6-- |
| COLUMN 51, | LINE 25, | change "Tetracyclin-" to --Tetracycline-- |

Signed and Sealed this

Fourth Day of September, 2007

JON W. DUDAS
*Director of the United States Patent and Trademark Office*